(12) United States Patent
Mulligan et al.

(10) Patent No.: US 11,642,417 B2
(45) Date of Patent: May 9, 2023

(54) COMPOSITIONS OF PROTEIN COMPLEXES AND METHODS OF USE THEREOF

(71) Applicant: BONUM THERAPEUTICS, INC., Seattle, WA (US)

(72) Inventors: John Thomas Mulligan, Seattle, WA (US); Shannon Lee Okada, Seattle, WA (US); Justin Richard Killebrew, Seattle, WA (US); Diane Louise Hollenbaugh, Seattle, WA (US)

(73) Assignee: Bonum Therapeutics, Inc., Seattle, WA (US)

( * ) Notice: Subject to any disclaimer, the term of this patent is extended or adjusted under 35 U.S.C. 154(b) by 0 days.

(21) Appl. No.: 17/504,385

(22) Filed: Oct. 18, 2021

(65) Prior Publication Data

US 2022/0047714 A1 Feb. 17, 2022

Related U.S. Application Data

(63) Continuation of application No. PCT/US2021/032313, filed on May 13, 2021.

(60) Provisional application No. 63/024,422, filed on May 13, 2020.

(51) Int. Cl.
*A61K 47/68* (2017.01)
*C07K 16/24* (2006.01)
*C07K 16/28* (2006.01)

(52) U.S. Cl.
CPC ...... *A61K 47/6813* (2017.08); *A61K 47/6845* (2017.08); *A61K 47/6849* (2017.08); *C07K 16/246* (2013.01); *C07K 16/249* (2013.01); *C07K 16/2818* (2013.01); *C07K 2317/31* (2013.01)

(58) Field of Classification Search
CPC ............ A61K 47/6813; A61K 47/6845; A61K 47/6849; A61K 38/00; A61K 47/6879; A61K 47/6889; A61K 2039/505; A61K 47/50; C07K 16/246; C07K 16/249; C07K 16/2818; C07K 2317/31; C07K 2317/92; C07K 2317/565; C07K 16/2827; C07K 2317/622; C07K 2317/90; C07K 16/244; C07K 16/2803; C07K 16/3007; C07K 2319/32; C07K 14/56; C07K 14/705; C07K 14/435; C07K 14/52; C07K 19/00; C07K 2319/33; C07K 2319/70; A61P 35/00
See application file for complete search history.

(56) References Cited

U.S. PATENT DOCUMENTS

| | | |
|---|---|---|
| 8,728,474 B2 | 5/2014 | Honjo et al. |
| 8,945,571 B2 | 2/2015 | Mossner et al. |
| 9,266,938 B2 | 2/2016 | Ast et al. |
| 9,447,159 B2 | 9/2016 | Ast et al. |
| 9,526,797 B2 | 12/2016 | Gerdes et al. |
| 9,546,203 B2 | 1/2017 | Kannan |
| 9,580,486 B2 | 2/2017 | Gavin et al. |
| 9,932,380 B2 | 4/2018 | Gavin et al. |
| 10,093,711 B2 | 10/2018 | Kannan |
| 10,118,970 B2 | 11/2018 | Fuh et al. |
| 10,184,009 B2 | 1/2019 | Ast et al. |
| 10,202,464 B2 | 2/2019 | Ast et al. |
| 10,294,287 B2 | 5/2019 | Greve |
| 10,316,104 B2 | 6/2019 | Ast et al. |
| 10,323,098 B2 | 6/2019 | Ast et al. |
| 10,561,739 B2 | 2/2020 | Howard et al. |
| 10,562,949 B2 | 2/2020 | Hosse et al. |
| 10,562,950 B2 | 2/2020 | Kannan |
| 10,570,204 B2 | 2/2020 | Johnson et al. |
| 10,603,360 B2 | 3/2020 | Gerdes et al. |
| 10,669,338 B2 | 6/2020 | Chang et al. |
| 10,766,938 B2 | 9/2020 | Greve |
| 10,774,126 B2 | 9/2020 | Greve |
| 10,829,535 B2 | 11/2020 | Gavin et al. |
| 10,858,412 B2 | 12/2020 | Mumm |
| 10,898,576 B2 | 1/2021 | Xie et al. |
| 11,008,401 B2 | 5/2021 | Fuh et al. |
| 11,028,174 B1 | 6/2021 | Gong et al. |
| 11,053,294 B2 | 7/2021 | Karow et al. |
| 11,098,099 B2 | 8/2021 | Klein et al. |
| 11,130,822 B2 | 9/2021 | Ast et al. |
| 2003/0143559 A1 | 7/2003 | Bracken et al. |
| 2016/0034043 A1 | 2/2016 | Le et al. |
| 2017/0198308 A1 | 7/2017 | Qi et al. |
| 2018/0326010 A1 | 11/2018 | Codarri Deak et al. |
| 2018/0326011 A1 | 11/2018 | Codarri et al. |
| 2019/0177439 A1 | 6/2019 | Wu |

(Continued)

FOREIGN PATENT DOCUMENTS

| | | |
|---|---|---|
| CN | 107915777 A | 4/2018 |
| WO | WO-2005082023 A2 | 9/2005 |

(Continued)

OTHER PUBLICATIONS

Lloyd et al., Protein Engineering, Design & Selection 22:159-168 (Year: 2009).*

(Continued)

*Primary Examiner* — Phuong Huynh

(74) *Attorney, Agent, or Firm* — Wilson Sonsini Goodrich & Rosati

(57) ABSTRACT

Provided herein are protein complexes comprising a sensor domain and a therapeutic domain linked by a linker, and methods of use thereof. In aspects of the present disclosure, activity of the therapeutic domain comprises a dependence on sensor domain binding to target markers.

21 Claims, 40 Drawing Sheets

Specification includes a Sequence Listing.

(56) References Cited

U.S. PATENT DOCUMENTS

| | | |
|---|---|---|
| 2019/0300592 A1 | 10/2019 | Struthers et al. |
| 2019/0314455 A1 | 10/2019 | Ptacin et al. |
| 2019/0338032 A1 | 11/2019 | Campbell et al. |
| 2020/0026890 A1 | 1/2020 | Iglesias et al. |
| 2020/0115429 A1 | 4/2020 | Greve |
| 2020/0172591 A1 | 6/2020 | Hosse et al. |
| 2020/0188526 A1 | 6/2020 | Klein et al. |
| 2020/0308285 A1 | 10/2020 | Wang et al. |
| 2020/0317787 A1 | 10/2020 | Li et al. |
| 2020/0339624 A1 | 10/2020 | Chu et al. |
| 2021/0017247 A1 | 1/2021 | Jones et al. |
| 2021/0024601 A1 | 1/2021 | Carlson et al. |
| 2021/0047382 A1 | 2/2021 | Greve |
| 2021/0094997 A1 | 4/2021 | Gavin et al. |
| 2021/0139560 A1 | 5/2021 | Larson et al. |
| 2021/0171596 A1 | 6/2021 | Moore et al. |
| 2021/0196796 A1 | 7/2021 | Penaflor-Aspuria et al. |
| 2021/0206806 A1 | 7/2021 | Larraillet et al. |
| 2021/0221864 A1 | 7/2021 | Williams et al. |
| 2021/0260163 A1 | 8/2021 | Yu et al. |

FOREIGN PATENT DOCUMENTS

| | | |
|---|---|---|
| WO | WO-2012107417 A1 | 8/2012 |
| WO | WO-2015118016 A1 | 8/2015 |
| WO | WO-2015123527 A1 | 8/2015 |
| WO | WO-2016200645 A1 | 12/2016 |
| WO | WO-2017220989 A1 | 12/2017 |
| WO | WO-2018184964 A1 | 10/2018 |
| WO | WO-2018218215 A1 | 11/2018 |
| WO | WO-2019010224 A1 | 1/2019 |
| WO | WO-2019143669 A1 | 7/2019 |
| WO | WO-2019147837 A2 | 8/2019 |
| WO | WO-2019222295 A1 | 11/2019 |
| WO | WO-2020014285 A2 | 1/2020 |
| WO | WO-2020069398 A1 | 4/2020 |
| WO | WO-2020088459 A1 | 5/2020 |
| WO | WO-2020242884 A1 | 12/2020 |
| WO | WO-2020247843 A2 | 12/2020 |
| WO | WO-2020259536 A1 | 12/2020 |
| WO | WO-2021011353 A1 | 1/2021 |
| WO | WO-2021030483 A1 | 2/2021 |
| WO | WO-2021030688 A1 | 2/2021 |
| WO | WO-2021142471 A1 | 7/2021 |
| WO | WO-2021178804 A1 | 9/2021 |

OTHER PUBLICATIONS

Edwards et al., J Mol Biol. 334(1): 103-118 (Year: 2003).*
Piche-Nicholas et al., MABS 10(1): 81-94 (Year: 2018).*
Ortiz-Sanchez et al., Expert Opin Biol Ther, 8(5): 609-632 (Year: 2008).*
Liang et al., Nature Communications 9: 4586 (Year: 2018).*
ABC Review: What are Stable Linkers? https://www.adcreview.com/the-review/linkers/what-are-stable-linkers/. 4 pages (Accessed on Jul. 22, 2020).
Borcherds et al., Optimal Affinity Enhancement by a Conserved Flexible Linker Controls p53 Mimicry in Mdmx. Biophysical Journal 112: 2038-2042 (2017).
Creative Biolabs: Non-cleavable Linker, https://www.creative-biolabs.com/adc/non-cleavable-linker.htm. 4 pages (Accessed on Jul. 22, 2020).
PCT/US2021/032313 International Search Report and Written Opinion dated Sep. 22, 2021.
Alberstein, et al., Design principles of protein switches. Curr Opin Struct Biol, vol. 72; Feb. 2022: 71-78.
Borcherds, et al., Optimal Affinity Enhancement by a conserved flexible linker controls p53 mimicry in MdmX. Biophysical Journal, vol. 112; May 2017:2038-2042.
Chen, et al., Autoinhibition of MDMX by intramolecular p53 mimicry. PNAS, vol. 112, No. 15; Apr. 2015:4624-4629.
Dueber, et al., Reprogramming control of an allosteric signaling switch through modular recombination, SCIENCE, vol. 301; Sep. 2003: 1904-1908.

* cited by examiner

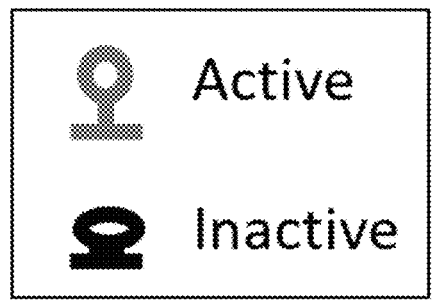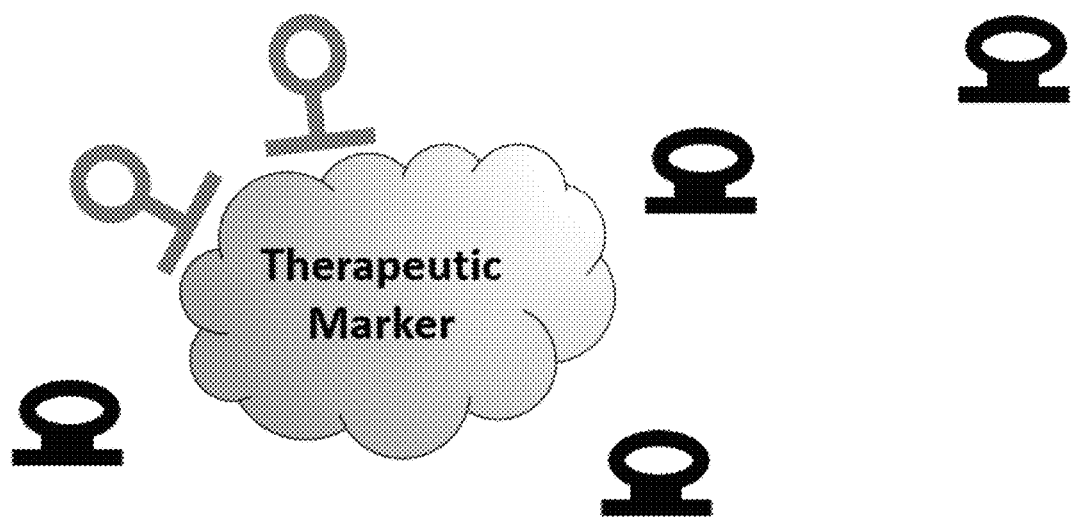
FIG. 2

FIG. 3 (SEQ ID NO: 40)

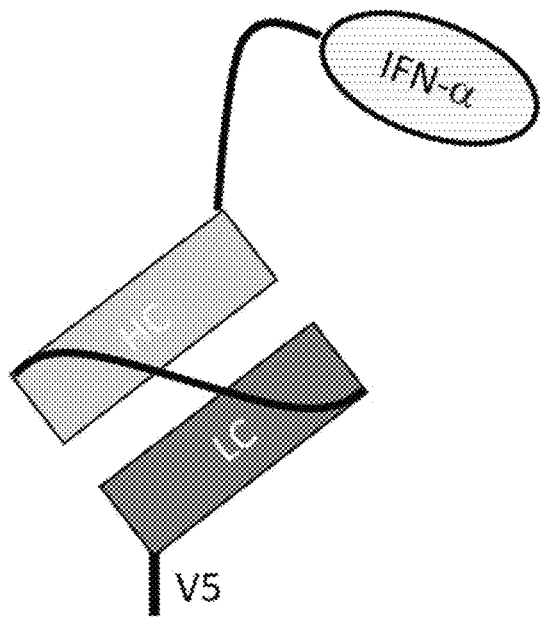

MSTSTCDLPQTHSLGSRRTLML
LAQMRRISLFSCLKDRHDFGFP
QEEFGNQFQKAETIPVLHEMIQ
QIFNLFSTKDSSAAWDETLLDK
FYTELYQQLNDLEACVIQGVGV
TETPLMKEDSILAVRKYFQRIT
LYLKEKKYSPCAWEVVRAEIMR
SFSLSTNLQESLRSKE
GGGGSGGGGSGGGGSGGGGS
QVQLVQSGAEVKKPGASVKVSC
KASGYTFSNYYVHWVRQAPGQG
LEWMGWMDPNSGGTGYAHQFQG
RVTMTRDTSTSTVYMELSSLRS
EDTAVYYCAKEVFSGWYDYWGQ
GTLVTVSS
ASGGGGSGGGGSGGGGSHAS
DIQMTQSPSSLSASVGDRVTIT
CRASQSISSYLNWYQQKPGKAP
KLLIYAASSLQSGVPSRFSGSG
SGTDFTLTISSLQPEDFATYYC
QQSYSTPYTFGQGTKVEIK
GKPIPNPLLGLDST

(SEQ ID NO: 41)

FIG. 8

SEQ ID NO: 42-44

SEQ ID NO: 45-47
SEQ ID NO: 181-182 & 212
SEQ ID NO: 183-185
SEQ ID NO: 186-188

SEQ ID NO: 48, 49, 44

SEQ ID NO: 51-52

SEQ ID NO: 53-54
SEQ ID NO: 174-175

SEQ ID NO: 77-79

Inactive

Inactive

Active

| | Fab: Her2 | PD1 |
|---|---|---|
| scFv | | |
| PD1/IL2 DBA 2B07 variant | 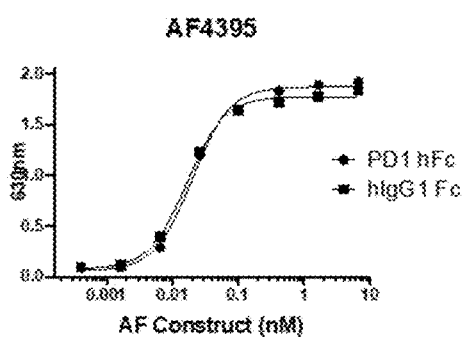<br>FIG. 17A | 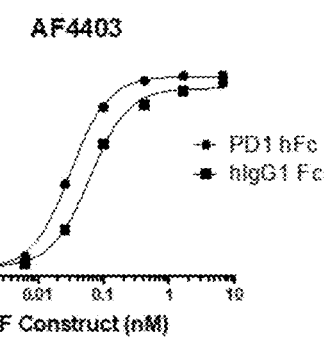<br>FIG. 17B |
| PD1/IL2 DBA 7A04 variant | 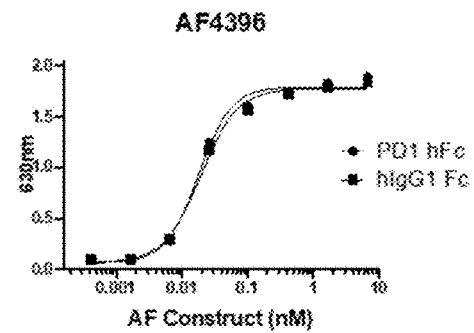<br>FIG. 17C | 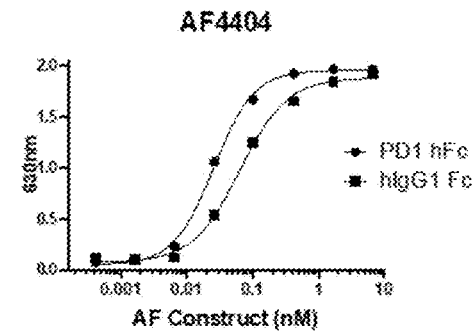<br>FIG. 17D |

| CloneID | IFNα binding (@5uM) | ELISA | SEQUENCES |
|---|---|---|---|
| i47_A03 | + | - | SEQ ID NO: 262 |
| I47_A11 | + | - | N/A |
| I47_A12 | + | - | N/A |
| I47_B03 | + | - | SEQ ID NO: 263 |
| I47_B07 | + | - | SEQ ID NO: 264 |
| I47_B11 | + | - | SEQ ID NO: 264 |
| AF317 | (KD < 10nM) | +++ | SEQ ID NO: 257 |
| AF372 | - | - | SEQ ID NO: 258 |

COMPOSITIONS OF PROTEIN COMPLEXES AND METHODS OF USE THEREOF

CROSS-REFERENCE

This application is a continuation of International Application Serial No. PCT/US2021/32313, filed May 13, 2021, which claims the benefit of U.S. Provisional Patent Application No. 63/024,422, filed May 13, 2020, each of which is entirely incorporated herein by reference in its entirety.

SEQUENCE LISTING

The instant application contains a Sequence Listing which has been submitted electronically in ASCII format and is hereby incorporated by reference in its entirety. Said ASCII copy, created on Jun. 21, 2021, is named 57824-701_601_SL.txt and is 870,829 bytes in size.

BACKGROUND

Many promising therapeutics that are needed locally exhibit toxicity upon systemic administration. There is a need for drugs that can be delivered systemically but can be regulated to exhibit therapeutic activity locally or in the presence of markers for disease.

SUMMARY

In various aspects, the present disclosure provides a complex comprising: a) a therapeutic domain; b) a linker; and c) a sensor domain, wherein the therapeutic domain is linked to the sensor domain by the linker, and wherein the sensor domain is capable of binding the therapeutic domain and a marker.

In some aspects, the sensor domain is bound to the therapeutic domain in an absence of the marker. In some aspects, the therapeutic domain is blocked from binding the sensor domain upon binding of the sensor domain to the marker. In some aspects, the activity of the therapeutic domain is reduced upon binding of the therapeutic domain to the sensor domain. In some aspects, the therapeutic domain is capable of exhibiting therapeutic activity upon binding of the sensor domain to the marker. In some aspects, the therapeutic domain is therapeutically active upon binding of the sensor domain to the marker.

In some aspects, the sensor domain comprises an antibody. In some aspects, the antibody is an antibody fragment or antibody derivative. In some aspects, the complex comprises an Fc domain. In some aspects, the complex comprises a domain that improves kinetic properties. In some aspects, the complex includes two heavy chains and two light chains.

In some aspects, the complex comprises two therapeutic domains. In some aspects, the complex comprises two sensor domains. In some aspects, the complex is a regulated therapeutic protein. In some aspects, the therapeutic domain is a cytokine, a chemokine, an antibody, an antibody fragment, a peptide agonist, a peptide antagonist, an enzyme, a soluble receptor, a growth factor, a protein toxin, a soluble ligand, a small molecule, or any combination thereof. In some aspects, the antibody or the antibody fragment comprises an IgG, a single domain antibody fragment, a nanobody, or a single chain variable fragment (scFv).

In some aspects, the therapeutic domain is an IL-2 receptor agonist. In some aspects, the IL-2 receptor agonist is IL-2, IL-15, or variants or fusions thereof. In some aspects, the therapeutic domain is IFNα, IFNγ IL-12, IL-4, IL-8, IL-10, IL-15, IL-18, IL-21, TGF beta, an anti-CD3 antibody, an anti-CD28 antibody or ligand, an antibody to or ligand of CD40, GITR, OX40, CD137, CD27, or Death Receptors, the extracellular domain of TGFBR2, VEGF-C, kynureninase, IL-7, TNF, MICA, MICB, CD47, an anti-CTLA4 antibody, an anti-PD-L1 antibody, or an anti-PD-1 antibody. In some aspects, the therapeutic domain binds to the sensor domain.

In some aspects, the linker is a polypeptide linker. In some aspects, the linker comprises from 2 to 200 amino acids in length. In some aspects, the linker is: attached to a heavy chain of the sensor domain, attached to a light chain of the sensor domain, is a fusion with an N-terminus of the sensor domain, or is a fusion with a C-terminus of the sensor domain. In some aspects, the linker is: attached to a heavy chain of the therapeutic domain, attached to a light chain of the therapeutic domain, is a fusion with an N-terminus of the therapeutic domain, or is a fusion with a C-terminus of the therapeutic domain.

In some aspects, the activity of the therapeutic domain is reduced when bound to the sensor domain. In some aspects, the therapeutic domain is inactive when bound to the sensor domain. In some aspects, the sensor domain blocks the activity of the therapeutic domain when bound to the therapeutic domain. In some aspects, the therapeutic domain is active when the sensor domain is bound to the marker. In some aspects, an affinity of the sensor domain for the marker is equal to or greater than an affinity of the sensor domain for the therapeutic domain.

In some aspects, an affinity of the sensor domain for the marker is at least 2 times, 5 times, 10 times, 100 times, 1000 times, 10000, or 100000 times greater than an affinity of the sensor domain for the therapeutic domain.

In some aspects, the sensor domain is an antibody or a fragment thereof. In some aspects, the sensor domain comprises one or both antigen binding domains of a bispecific antibody. In some aspects, the bispecific antibody comprises a first antigen binding domain that is capable of binding to the therapeutic domain and is capable of binding to the marker, and a second antigen binding domain that is capable of binding to the marker. In some aspects, the bispecific antibody comprises a first antigen binding domain that is capable of binding to the therapeutic domain and the marker and a second antigen binding domain that is capable of binding to a second marker. In some aspects, the bispecific antibody comprises a first antigen binding domain that is capable of binding to the therapeutic domain and the marker and a second antigen binding domain that is capable of binding to the therapeutic domain and a second marker. In some aspects, the bispecific antibody comprises a single therapeutic domain.

In some aspects, the therapeutic domain is IFNα, the first marker is ATP, and the second marker is CEA. In some aspects, the sensor domain binds to an IL-2 receptor agonist and to PD-1. In some aspects, the IL-2 receptor agonist is IL-2, IL-15, or variants or fusions thereof. In some aspects, the sensor domain binds to IFNα and PD-L1.

In some aspects, the marker is a surface protein, a cell surface marker, or soluble ATP. In some aspects, the marker is a secreted protein. In some aspects, the marker is expressed by a cancer cell. In some aspects, the marker is expressed by an immune cell. In some aspects, the marker is PD-1. In some aspects, the marker is PD-L1. In some aspects, the marker is CEACAM5. In some aspects, the marker is FAP. In some aspects, the marker is LRRC15. In some aspects, the marker is expressed by a stromal cell. In some aspects, the marker is expressed by an endothelial cell.

In some aspects, the marker is a metabolite. In some aspects, the marker is adenosine, AMP, ADP, or ATP. In some aspects, the marker is kynurenine.

In some aspects, the sensor domain comprises a complementarity determining region selected from TABLE 13 or TABLE 18. In some aspects, the sensor domain is selected from TABLE 13. In some aspects, the complex is selected from TABLE 15.

In some aspects, the sensor domain comprises a complementarity determining region having at least 80%, at least 85%, at least 90%, at least 95%, at least 97%, at least 99%, or 100% sequence identity to any one of SEQ ID NO: 1-SEQ ID NO: 20 or SEQ ID NO: 142-SEQ ID NO: 173, or SEQ ID NO: 238-252. In some aspects, the sensor domain has at least 80%, at least 85%, at least 90%, at least 95%, at least 97%, at least 99%, or 100% sequence identity to any one of SEQ ID NO: 21-SEQ ID NO: 27, SEQ ID NO: 31-SEQ ID NO: 39, or SEQ ID NO: 127-SEQ ID NO: 141. In some aspects, the protein complex has at least 80%, at least 85%, at least 90%, at least 95%, at least 97%, at least 99%, or 100% sequence identity to any one of SEQ ID NO: 41, SEQ ID NO: 44, SEQ ID NO: 80-SEQ ID NO: 112, SEQ ID NO: 174-175, SEQ ID NO: 181-182, SEQ ID NO: 195-196, SEQ ID NO: 205-206, SEQ ID NO: 210-212, SEQ ID NO: 220-223, SEQ ID NO: 226-231, SEQ ID NO: 259-261, SEQ ID NO: 266-282, SEQ ID NO: 289-293, or a fragment thereof.

In various aspects, the present disclosure provides a method comprising administering any of the above complexes to a subject in need thereof. In various aspects, the present disclosure provides a method of treating a subject in need thereof comprising administering any of the above complexes to the subject in need thereof. In some aspects, the administering comprises intravenous, intramuscular, or subcutaneous administration. In some aspects, the subject in need thereof has cancer. In some aspects, the subject in need thereof has an autoimmune disease. In some aspects, the subject in need thereof has a viral disease. In some aspects, the therapeutic domain treats the subject in need thereof. In some aspects, the subject in need thereof is a mammal. In some aspects, the subject in need thereof is a human.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the disclosure are set forth with particularity in the appended claims. The patent or application file contains at least one drawing executed in color. Copies of this patent or patent application publication with color drawing(s) will be provided by the Office upon request and payment of the necessary fee. A better understanding of the features and advantages of the present disclosure will be obtained by reference to the following detailed description that sets forth illustrative embodiments, in which the principles of the disclosure are utilized, and the accompanying drawings of which:

FIG. 1A shows an exemplary dual binding protein complex in an inactive state. The protein complex has a sensor domain and a therapeutic domain. The sensor domain and therapeutic domain are linked by a linker. The sensor domain is shown bound to the therapeutic domain, rendering the therapeutic domain inactive. FIG. 1B shows an exemplary dual binding protein complex in an active state. The protein complex has a sensor domain and a therapeutic domain. The sensor domain and therapeutic domain are linked by a linker. The sensor domain is shown bound to a marker (e.g., a tumor marker or other disease marker), rendering the therapeutic domain active.

FIG. 2 shows an example of a protein complex in an active state when bound to a tumor and examples of protein complex in an inactive state when not bound to a tumor.

FIG. 3 shows an exemplary gBlock sequence used for cell-free expression of scFv antibodies. FIG. 3 discloses SEQ ID NO: 40.

FIG. 8 shows a schematic of a protein complex comprising a cytokine therapeutic domain and a DBA (at left) and said protein complex's sequence (at right). FIG. 8 discloses SEQ ID NO: 41.

FIG. 9A shows a first embodiment of the protein complex disclosed herein; FIG. 9B shows a second embodiment of the protein complex disclosed herein; FIG. 9C shows a third embodiment of the protein complex disclosed herein; FIG. 9D shows a fourth embodiment of the protein complex disclosed herein; FIG. 9E shows a fifth embodiment of the protein complex disclosed herein; and FIG. 9F shows a sixth embodiment of the protein complex disclosed herein.

FIG. 13A shows that when neither target is present, the therapeutic domain is inactive; FIG. 13B shows that when only one target is present, the therapeutic domain is inactive; and FIG. 13C shows that when both targets are present, the therapeutic domain is active.

FIG. 15A provides the IL-2 activity of an PD-1/IL-2 DBA-IL-2 complex. FIG. 15B provides the IL-2 activity of an anti-Her2 antibody-IL-2 complex. FIG. 15C provides the activity of an anti-IL-2 antibody-IL-2 complex. FIG. 15D provides the activity of an anti-PD-1 antibody-IL-2 complex.

FIG. 16A-C provide the IL-2 activities of three different PD-1/IL-2 DBA-IL-2 complexes. FIG. 16D provides the activity of an anti-PD-1 antibody-IL-2 complex. FIG. 16E provides the activity of an anti-Her-2 antibody-IL-2 complex. FIG. 16F provides the activity of an anti-IL-2 antibody-IL-2 complex.

FIG. 17A-H provide IL-2 activity of protein complexes comprising the structure depicted in FIG. 14C in wells coated with PD-1-Fc or an IgG1 control protein. Activity was measured as growth of a 630 nm signal from HEK-Blue™ IL-2 reporter cells. FIGS. 17B and 17D provide results for two PD-1/IL-2 DBA complexes comprising anti-PD-1 domains in the Fab arms and a PD-1/IL-2 DBA scFv on the Fc arm. FIGS. 17A, 17C, and 17E-H provide results for control protein complexes.

DETAILED DESCRIPTION

Figure 1A:
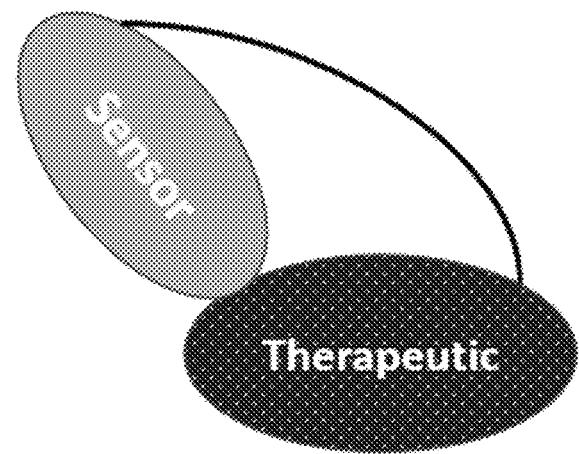
FIGS. 1A and 1B shows a schematic of the protein complexes of the present disclosure.
Figure 1B:
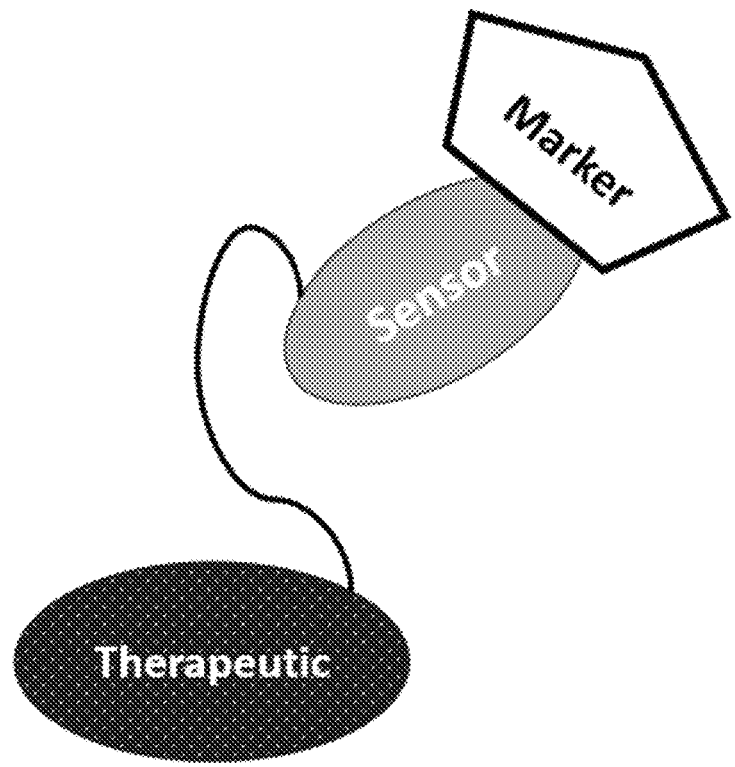
Figure 4:
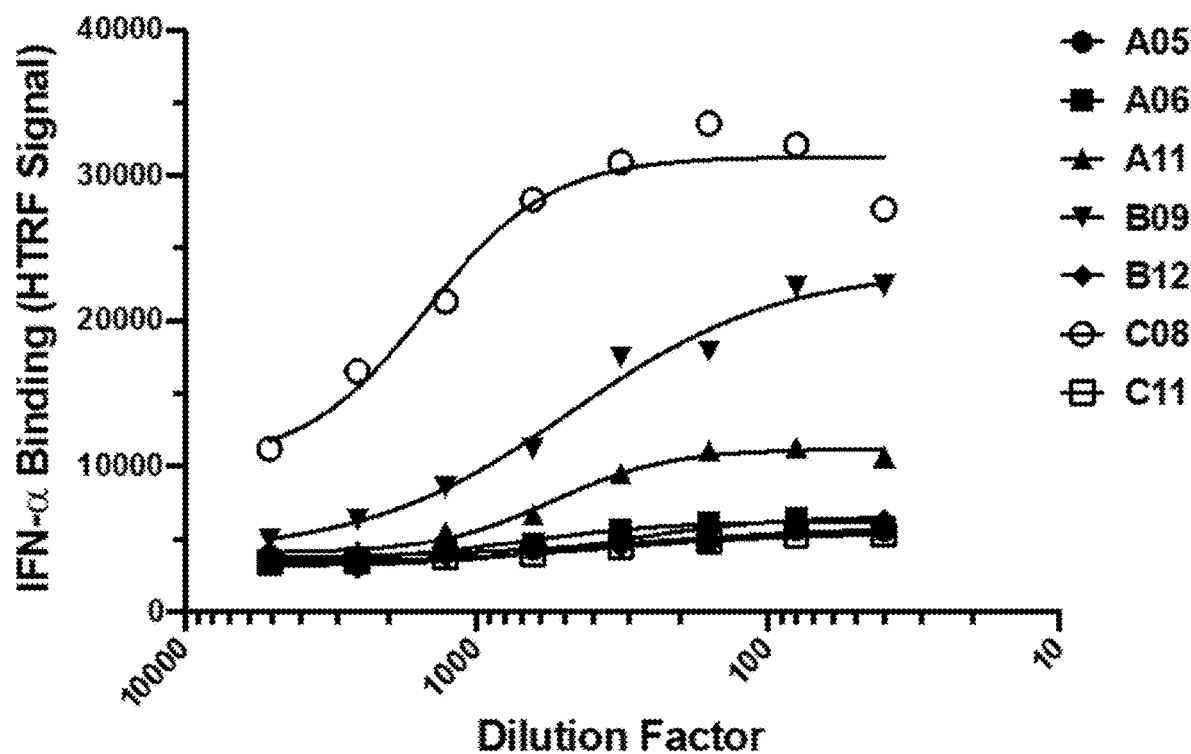
FIG. 4 shows candidate PD-L1/IFNα DBAs bind IFNα.
Figure 5:
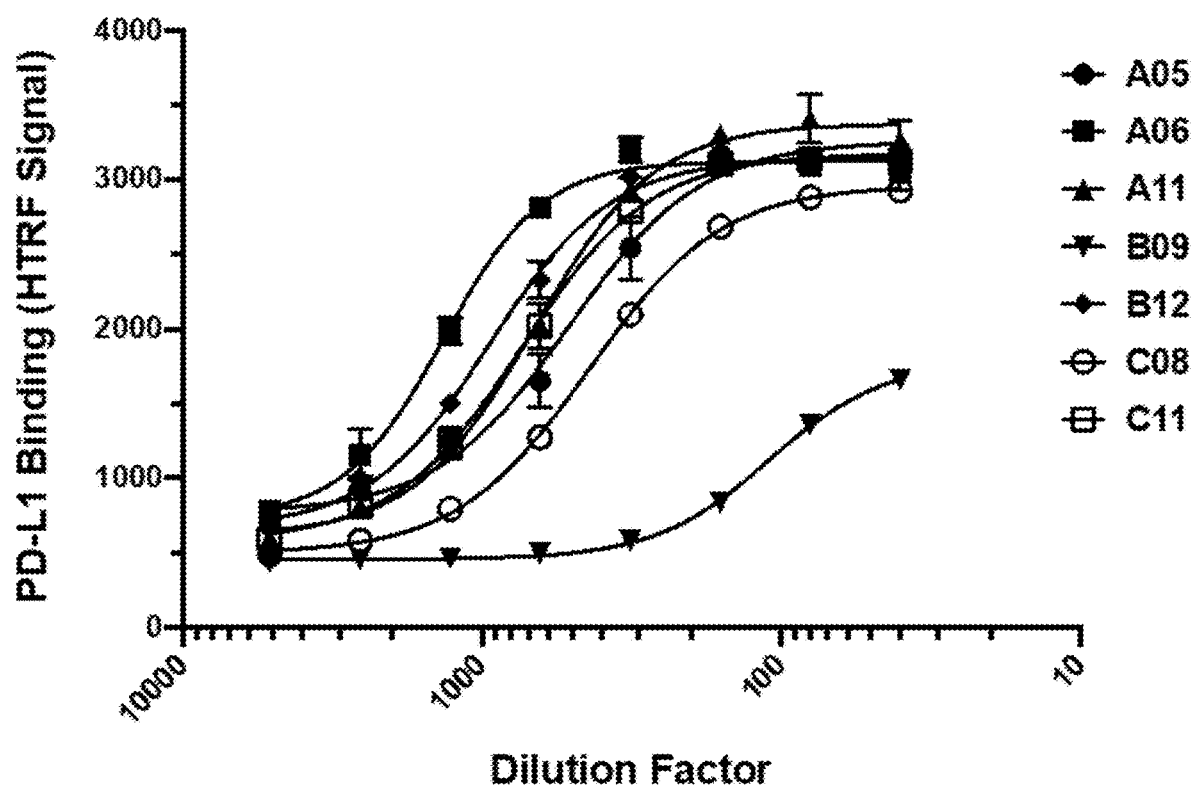
FIG. 5 shows candidate PD-L1/IFNα DBAs bind PD-L1.
Figure 6:
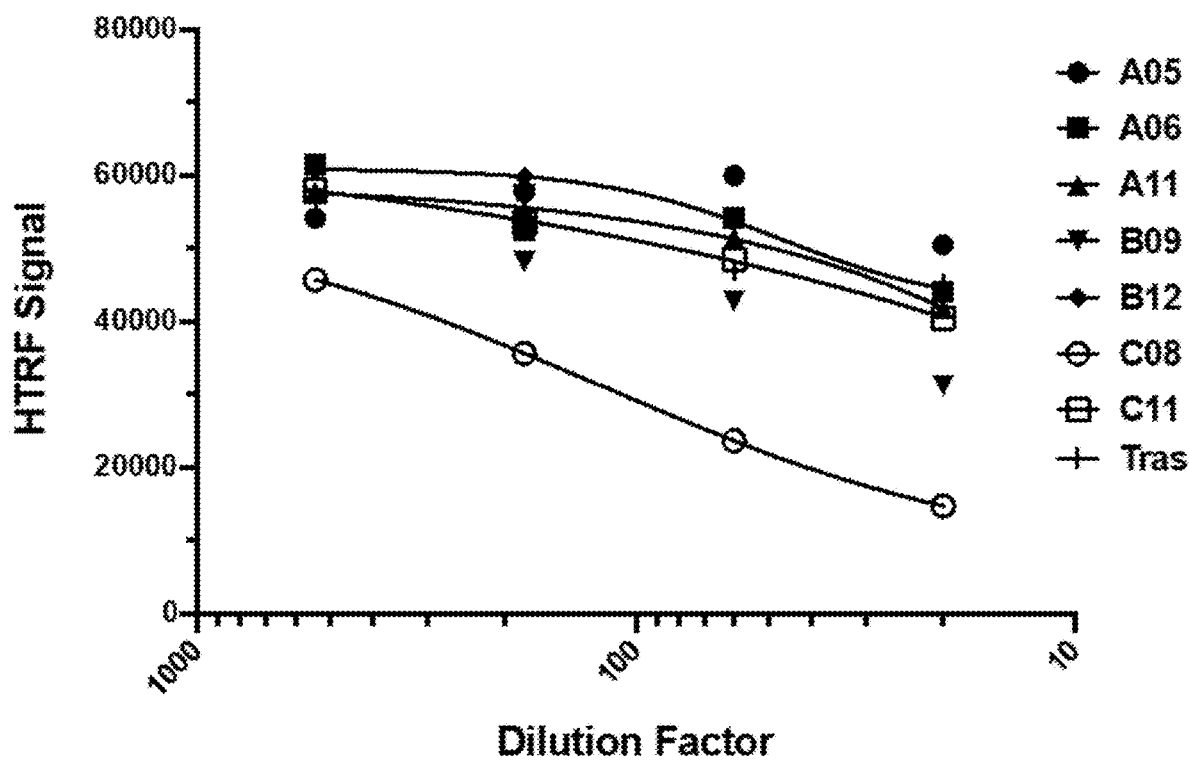
FIG. 6 shows inhibition of IFNα binding to IFNAR by candidate PD-L1/IFNα DBAs.

The present disclosure provides compositions of protein complexes and methods of use thereof. Promising therapeutics are often unable to be realized due to harmful side effects, or systemic on-target toxicity. Provided herein are protein complexes, which specifically exhibit therapeutic efficacy locally, where the relevant cells and targets are present. Moreover, protein complexes of the present disclosure are self-regulated, remaining inactive in the absence of a specific marker and activating in the presence of the specific marker. The protein complexes disclosed herein may include a sensor domain (e.g, an antibody or scFv) that is linked to a therapeutic domain (e.g., a cytokine, a therapeutic antibody domain, a receptor, a ligand) via a linker. The sensor domain may be a dual binding protein that has affinity for the therapeutic domain and a specific marker, such that the marker and the therapeutic domain compete for binding to the sensor domain. In some embodiments, the dual binding protein is a dual binding antibody. In the absence of the marker, the sensor domain binds the therapeutic domain, rendering the therapeutic domain unable to exert activity. When the sensor domain is bound to the marker, the therapeutic domain is unbound and may exert activity. In some embodiments, regulation of therapeutic activity by the complex may be reversible, that is, when the sensor domain disassociates from the marker, the sensor domain may bind the therapeutic domain, rendering the therapeutic domain once again unable to exert activity. Thus, the protein complexes of the present disclosure comprise sensor domains that regulate therapeutic domains in the presence of the marker, bind the marker, and render the therapeutic domain active. Various structures and compositions of protein complexes are disclosed herein, including pharmaceutical formulations. Also provided herein are methods for treating a subject in need thereof by administering the protein complex to the subject.

As used herein, a "marker" may refer to the moiety that is bound by the sensor domain of the protein complexes disclosed herein. Non-limiting examples of a "marker" include a protein, a protein modification, a carbohydrate, a metabolite, or any other molecule that can be bound by an antibody. A marker may also refer to a disease-specific marker, such as a molecular marker of a disease state (e.g., cancer).

As used herein, a "target" may refer to a molecule through which the therapeutic domain of the protein complexes disclosed herein may act. Non-limiting examples of a "target" include cytokine receptor, a cytokine, a ligand, an enzyme substrate, or any other molecule that, when contacted by the therapeutic domain, has a therapeutic impact on a subject (e.g., human or non-human animal) administered the protein complex.

As used herein, an "antibody" may refer to an antibody, an antibody derivative, or fragment(s) thereof that contains part or all of an antibody variable domain.

The term "recombinant nucleic acid" refers to synthetic nucleic acid having a nucleotide sequence that is not naturally occurring. A recombinant nucleic acid may be synthesized in the laboratory. A recombinant nucleic acid is prepared by using recombinant DNA technology by using enzymatic modification of DNA, such as enzymatic restriction digestion, ligation, and DNA cloning. A recombinant nucleic acid as used herein can be DNA, or RNA. A recombinant DNA may be transcribed in vitro, to generate a messenger RNA (mRNA), the recombinant mRNA may be isolated, purified and used to transfect a cell. A recombinant nucleic acid may encode a protein or a polypeptide. A recombinant nucleic acid, under suitable conditions, can be incorporated into a living cell, and can be expressed inside the living cell. As used herein, "expression" of a nucleic acid usually refers to transcription and/or translation of the nucleic acid. The product of a nucleic acid expression is usually a protein but can also be an mRNA. Detection of an mRNA encoded by a recombinant nucleic acid in a cell that has incorporated the recombinant nucleic acid, is considered positive proof that the nucleic acid is "expressed" in the cell.

The process of inserting or incorporating a nucleic acid into a cell can be via transformation, transfection or transduction. Transformation is the process of uptake of foreign nucleic acid by a bacterial cell. This process is adapted for propagation of plasmid DNA, protein production, and other applications. Transformation introduces recombinant plasmid DNA into competent bacterial cells that take up extracellular DNA from the environment. Some bacterial species are naturally competent under certain environmental conditions, but competence is artificially induced in a laboratory setting. Transfection is the forced introduction of small molecules such as DNA, RNA, or antibodies into eukaryotic cells. Just to make life confusing, 'transfection' also refers to the introduction of bacteriophage into bacterial cells. 'Transduction' is mostly used to describe the introduction of recombinant viral vector particles into target cells, while 'infection' refers to natural infections of humans or animals with wild-type viruses.

Protein Complexes

The present disclosure provides complexes that may self-regulate therapeutic activity. Protein complexes of the present disclosure may include a sensor domain and a therapeutic domain. The sensor domain and therapeutic domain may be linked by a linker. The sensor domain may regulate the activity of the therapeutic domain. Regulation of the activity of the therapeutic domain may include binding of the sensor domain to the therapeutic domain, rendering the therapeutic domain unable to exert therapeutic activity. Regulation of the activity of the therapeutic domain may further include unbinding, or release, of the therapeutic domain by the sensor domain upon binding of the sensor domain to a marker. The marker may be expressed by a cell associated with a disease. For example, the disease may be cancer, the cell may be a tumor cell, and the marker may be a tumor-specific marker that is expressed on tumor cells. Thus, the protein complexes of the present disclosure are superior drug candidates as the sensor domain-dependent activity of the therapeutic domain allows for localized activity, even upon systemic administration of the protein complex. Compared to therapeutic domains administered on their own, the protein complexes of the present disclosure exhibit regulated therapeutic activity of the therapeutic domain. As a result, compared to free therapeutic domains administered on their own, the protein complexes of the present disclosure exhibit reduced systemic on-target toxicity.

The protein complexes of the present disclosure can have an Fc region. The protein complexes of the present disclosure can have a domain that improves kinetic properties. For example, the protein complexes of the present disclosure may be further coupled to a half-life extender, such as an Fc region, albumin, PEG, or another zwitterionic polymer. The protein complexes of the present disclosure may have two heavy chains and two light chains. The protein complexes of the present disclosure may have two heavy chains and one light chain. The protein complexes of the present disclosure may include multiple sensor domains and multiple therapeutic domains. For example, a protein complex of the present disclosure may include two sensor domains and two therapeutic domains, all of which are linked and in which the two therapeutic domains are bound to the two sensor domains. In some embodiments, a protein complex of the present disclosure may include two sensor domains and one therapeutic domain, all of which are linked and in which the therapeutic domain may bind to both sensor domains or only one of the two sensor domains.

In some embodiments, the marker may be a surface protein, such as a cell surface protein. The marker may also be soluble ATP. In some embodiments, the marker may be a secreted protein. For example, the secreted protein may be a protein that is released by proliferating tumor cells. In some embodiments, the marker may be expressed by a cancer cell. The marker may be expressed by an immune cell. The marker may be expressed by a stromal cell. The marker may be expressed by an endothelial cell. Exemplary markers include PD1, PD-L1, CEACAM5, FAP, LRRC15, a metabolite, adenosine, AMP, ADP, ATP, or kynurenine. Other markers may include CRIPTO, CD19, CD20, CD22, CD30, CD33, Glycoprotein NMB, CanAg, HER2 (ErbB2/Neu), CD56 (NCAM), CD70, CD79, CD138, PSCA, PSMA (prostate specific membrane antigen), BCMA, E-selectin, EphB2, Melanotransferin, Muc16 and TMEFF2, or any other marker described in U.S. Pat. No. 10,561,739, incorporated herein by reference in its entirety. Other markers may also include BMPR1B, E16, STEAP1, 0772P, MPF, Napi3b, Sema 5b, PSCA hlg, ETBR, MSG783, STEAP2, TrpM4, CD21, CD79b, FcRH2, NCA, MDP, IL20Rα, Brevican, EphB2R, ASLG659, PSCA, GEDA, BAFF-R, CD79a, CXCR5, HLA-DOB, P2X5, CD72, FCRHI, IRTA2, or any other marker described in WO 2005/082023, incorporated herein by reference in its entirety.

In some embodiments, binding of the sensor domain to the therapeutic domain versus binding of the sensor domain to a marker is regulated by the relative affinity of the sensor domain for the therapeutic domain. In some embodiments, the sensor domain may have a dissociation constant (Kd) for the marker that is lower than the dissociation constant of the sensor domain for the therapeutic domain. Thus, the sensor may have a higher affinity (lower Kd) for the marker than for the therapeutic domain. The sensor domains of the present disclosure may be engineered, for example by affinity maturation, to have a higher affinity (lower dissociation constant) for the marker than the therapeutic domain. In the absence of the marker, the sensor domain of the present disclosure may have a sufficiently high affinity for the therapeutic domain such that the therapeutic domain is bound by the sensor domain. In the presence of the marker, the affinity of the sensor domain for the marker is sufficiently high (low dissociation constant), such that the marker outcompetes the therapeutic domain for binding to the sensor domain. As a result, the equilibrium binding shifts from a state in which the sensor domain is bound to the therapeutic domain to a state in which the therapeutic domain is unbound and the sensor domain binds to the marker.

The sensor domain may have an affinity for the marker that is at least 2-fold higher than an affinity for the therapeutic domain. The sensor domain may have an affinity for the marker that is at least 5-fold higher than an affinity for the therapeutic domain. The sensor domain may have an affinity for the marker that is at least 10-fold higher than an affinity for the therapeutic domain. The sensor domain may have an affinity for the marker that is at least 15-fold higher than an affinity for the therapeutic domain. The sensor domain may have an affinity for the marker that is at least 20-fold higher than an affinity for the therapeutic domain. The sensor domain may have an affinity for the marker that is at least 25-fold higher than an affinity for the therapeutic domain. The sensor domain may have an affinity for the marker that is at least 30-fold higher than an affinity for the therapeutic domain. The sensor domain may have an affinity for the marker that is at least 35-fold higher than an affinity for the therapeutic domain. The sensor domain may have an affinity for the marker that is at least 40-fold higher than an affinity for the therapeutic domain. The sensor domain may have an affinity for the marker that is at least 45-fold higher than an affinity for the therapeutic domain. The sensor domain may have an affinity for the marker that is at least 50-fold higher than an affinity for the therapeutic domain. The sensor domain may have an affinity for the marker that is at least 60-fold higher than an affinity for the therapeutic domain. The sensor domain may have an affinity for the marker that is at least 70-fold higher than an affinity for the therapeutic domain. The sensor domain may have an affinity for the marker that is at least 80-fold higher than an affinity for the therapeutic domain. The sensor domain may have an affinity for the marker that is at least 90-fold higher than an affinity for the therapeutic domain. The sensor domain may have an affinity for the marker that is at least 100-fold higher than an affinity for the therapeutic domain. The sensor domain may have an affinity for the marker that is at least 150-fold higher than an affinity for the therapeutic domain. The sensor domain may have an affinity for the marker that is at least 200-fold higher than an affinity for the therapeutic domain. The sensor domain may have an affinity for the marker that is at least 250-fold higher than an affinity for the therapeutic domain. The sensor domain may have an affinity for the marker that is at least 300-fold higher than an affinity for the therapeutic domain. The sensor domain may have an affinity for the marker that is at least 350-fold higher than an affinity for the therapeutic domain. The sensor domain may have an affinity for the marker that is at least 400-fold higher than an affinity for the therapeutic domain. The sensor domain may have an affinity for the marker that is at least 450-fold higher than an affinity for the therapeutic domain. The sensor domain may have an affinity for the marker that is at least 500-fold higher than an affinity for the therapeutic domain. The sensor domain may have an affinity for the marker that is at least 1000-fold higher than an affinity for the therapeutic domain. The sensor domain may have an affinity for the marker that is at least 10000-fold higher than an affinity for the therapeutic domain. The sensor domain may have an affinity for the marker that is at least 100000-fold higher than an affinity for the therapeutic domain. The sensor domain may have an affinity for the marker that is from 2 to 10-fold higher than an affinity for the therapeutic domain. The sensor domain may have an affinity for the marker that is from 10 to 20-fold higher than an affinity for the therapeutic domain. The sensor domain may have an affinity for the marker that is from 20 to 30-fold higher than an affinity for the therapeutic domain. The sensor domain may have an affinity for the marker that is from 30 to 40-fold higher than an affinity for the therapeutic domain. The sensor domain may have an affinity for the marker that is from 40 to 50-fold higher than an affinity for the therapeutic domain. The sensor domain may have an affinity for the marker that is from 50 to 100-fold higher than an affinity for the therapeutic domain. The sensor domain may have an affinity for the marker that is from 100 to 150-fold higher than an affinity for the therapeutic domain. The sensor domain may have an affinity for the marker that is from 150 to 200-fold higher than an affinity for the therapeutic domain. The sensor domain may have an affinity for the marker that is from 200 to 250-fold higher than an affinity for the therapeutic domain. The sensor domain may have an affinity for the marker that is from 250 to 300-fold higher than an affinity for the therapeutic domain. The sensor domain may have an affinity for the marker that is from 300 to 350-fold higher than an affinity for the therapeutic domain. The sensor domain may have an affinity for the marker that is from 350 to 400-fold higher than an affinity for the therapeutic domain. The sensor domain may have an affinity for the marker that is from 400 to 450-fold higher than an affinity for the therapeutic domain. The sensor domain may have an affinity for the marker that is from 450 to 500-fold higher than an affinity for the therapeutic domain. The sensor domain may have an affinity for the marker that is from 500 to 1000-fold higher than an affinity for the therapeutic domain. The sensor domain may have an affinity for the marker that is from 10 to 80-fold higher than an affinity for the therapeutic domain. The sensor domain may have an affinity for the marker that is from 30 to 70-fold higher than an affinity for the therapeutic domain. The sensor domain may have an affinity for the marker that is from 40 to 60-fold higher than an affinity for the therapeutic domain. The sensor domain may have an affinity for the marker that is from 20 to 50-fold higher than an affinity for the therapeutic domain. The sensor domain may have an affinity for the marker that is from 10 to 1000-fold higher than an affinity for the therapeutic domain. The sensor domain may have an affinity for the marker that is from 70 to 500-fold higher than an affinity for the therapeutic domain. The sensor domain may have an affinity for the marker that is from 100 to 500-fold higher than an affinity for the therapeutic domain. The sensor domain may have an affinity for the marker that is from 500 to 750-fold higher than an affinity for the therapeutic domain. The sensor domain may have an affinity for the marker that is from 250 to 750-fold higher than an affinity for the therapeutic domain. The sensor domain may have an affinity for the marker that is from 1000 to 100000-fold higher than an affinity for the therapeutic domain. The sensor domain may have an affinity for the marker that is from 2 to 100000-fold higher than an affinity for the therapeutic domain.

A protein complex of the present disclosure, or a fragment thereof, may comprise one or more complementary determining regions (CDRs) having have at least 80% sequence identity to any one of the CDRs disclosed herein. For example, a protein complex of the present disclosure, or a fragment thereof, may comprise one or more CDRs having at least 80% sequence identity to any one of SEQ ID NO: 1-SEQ ID NO: 20, SEQ ID NO: 142-173, or SEQ ID NO: 238-252. A protein complex of the present disclosure, or a fragment thereof, may comprise one or more CDRs having at least 85% sequence identity to any one of SEQ ID NO: 1-SEQ ID NO: 20, SEQ ID NO: 142-173, or SEQ ID NO: 238-252. A protein complex of the present disclosure, or a fragment thereof, may comprise one or more CDRs having at least 90% sequence identity to any one of SEQ ID NO: 1-SEQ ID NO: 20, SEQ ID NO: 142-173, or SEQ ID NO: 238-252. A protein complex of the present disclosure, or a fragment thereof, may comprise one or more CDRs having at least 92% sequence identity to any one of SEQ ID NO: 1-SEQ ID NO: 20, SEQ ID NO: 142-173, or SEQ ID NO: 238-252. A protein complex of the present disclosure, or a fragment thereof, may comprise one or more CDRs having at least 95% sequence identity to any one of SEQ ID NO: 1-SEQ ID NO: 20, SEQ ID NO: 142-173, or SEQ ID NO: 238-252. A protein complex of the present disclosure, or a fragment thereof, may comprise one or more CDRs having at least 97% sequence identity to any one of SEQ ID NO: 1-SEQ ID NO: 20, SEQ ID NO: 142-173, or SEQ ID NO: 238-252. A protein complex of the present disclosure, or a fragment thereof, may comprise one or more CDRs having at least 99% sequence identity to any one of SEQ ID NO: 1-SEQ ID NO: 20, SEQ ID NO: 142-173, or SEQ ID NO: 238-252. A protein complex of the present disclosure, or a fragment thereof, may comprise one or more CDRs having any one of SEQ ID NO: 1-SEQ ID NO: 20, SEQ ID NO: 142-173, or SEQ ID NO: 238-252.

A protein complex, or a fragment thereof, can have at least 80% sequence identity to any one of SEQ ID NO: 41, SEQ ID NO: 44, SEQ ID NO: 80-SEQ ID NO: 112, SEQ ID NO: 174-175, SEQ ID NO: 181-182, SEQ ID NO: 195-196, SEQ ID NO: 205-206, SEQ ID NO: 210-212, SEQ ID NO: 220-223, SEQ ID NO: 226-231, SEQ ID NO: 259-261, SEQ ID NO: 266-282, or SEQ ID NO: 289-293, or a fragment thereof. A protein complex can have at least 85% sequence identity to any one of SEQ ID NO: 41, SEQ ID NO: 44, SEQ ID NO: 80-SEQ ID NO: 112, SEQ ID NO: 174-175, SEQ ID NO: 181-182, SEQ ID NO: 195-196, SEQ ID NO: 205-206, SEQ ID NO: 210-212, SEQ ID NO: 220-223, SEQ ID NO: 226-231, SEQ ID NO: 259-261, SEQ ID NO: 266-282, or SEQ ID NO: 289-293, or a fragment thereof. A protein complex can have at least 90% sequence identity to any one of SEQ ID NO: 41, SEQ ID NO: 44, SEQ ID NO: 80-SEQ ID NO: 112, SEQ ID NO: 174-175, SEQ ID NO: 181-182, SEQ ID NO: 195-196, SEQ ID NO: 205-206, SEQ ID NO: 210-212, SEQ ID NO: 220-223, SEQ ID NO: 226-231, SEQ ID NO: 259-261, SEQ ID NO: 266-282, or SEQ ID NO: 289-293, or a fragment thereof. A protein complex can have at least 92% sequence identity to any one of SEQ ID NO: 41, SEQ ID NO: 44, SEQ ID NO: 80-SEQ ID NO: 112, SEQ ID NO: 174-175, SEQ ID NO: 181-182, SEQ ID NO: 195-196, SEQ ID NO: 205-206, SEQ ID NO: 210-212, SEQ ID NO: 220-223, SEQ ID NO: 226-231, SEQ ID NO: 259-261, SEQ ID NO: 266-282, or SEQ ID NO: 289-293, or a fragment thereof. A protein complex can have at least 95% sequence identity to any one of SEQ ID NO: 41, SEQ ID NO: 44, SEQ ID NO: 80-SEQ ID NO: 112, SEQ ID NO: 174-175, SEQ ID NO: 181-182, SEQ ID NO: 195-196, SEQ ID NO: 205-206, SEQ ID NO: 210-212, SEQ ID NO: 220-223, SEQ ID NO: 226-231, SEQ ID NO: 259-261, SEQ ID NO: 266-282, or SEQ ID NO: 289-293, or a fragment thereof. A protein complex can have at least 97% sequence identity to any one of SEQ ID NO: 41, SEQ ID NO: 44, SEQ ID NO: 80-SEQ ID NO: 112, SEQ ID NO: 174-175, SEQ ID NO: 181-182, SEQ ID NO: 195-196, SEQ ID NO: 205-206, SEQ ID NO: 210-212, SEQ ID NO: 220-223, SEQ ID NO: 226-231, SEQ ID NO: 259-261, SEQ ID NO: 266-282, or SEQ ID NO: 289-293, or a fragment thereof. A protein complex can have at least 99% sequence identity to any one of SEQ ID NO: 41, SEQ ID NO: 44, SEQ ID NO: 80-SEQ ID NO: 112, SEQ ID NO: 174-175, SEQ ID NO: 181-182, SEQ ID NO: 195-196, SEQ ID NO: 205-206, SEQ ID NO: 210-212, SEQ ID NO: 220-223, SEQ ID NO: 226-231, SEQ ID NO: 259-261, SEQ ID NO: 266-282, or SEQ ID NO: 289-293, or a fragment thereof. A protein complex is any one of SEQ ID NO: 41, SEQ ID NO: 44, SEQ ID NO: 80-SEQ ID NO: 112, SEQ ID NO: 174-175, SEQ ID NO: 181-182, SEQ ID NO: 195-196, SEQ ID NO: 205-206, SEQ ID NO: 210-212, SEQ ID NO: 220-223, SEQ ID NO: 226-231, SEQ ID NO: 259-261, SEQ ID NO: 266-282, or SEQ ID NO: 289-293, or a fragment thereof.

A protein complex of the present disclosure may have at least 95% sequence identity to any one of SEQ ID NO: 41, SEQ ID NO: 44, SEQ ID NO: 80-SEQ ID NO: 112, SEQ ID NO: 174-175, SEQ ID NO: 181-182, SEQ ID NO: 195-196, SEQ ID NO: 205-206, SEQ ID NO: 210-212, SEQ ID NO: 220-223, SEQ ID NO: 226-231, SEQ ID NO: 259-261, SEQ ID NO: 266-282, or SEQ ID NO: 289-293, or a fragment thereof and have one or more CDRs with at least 80% sequence identity to any one SEQ ID NO: 1-SEQ ID NO: 20, SEQ ID NO: 142-173, or SEQ ID NO: 238-252. The protein complexes of the present disclosure can have CDRs selected from SEQ ID NO: 1-SEQ ID NO: 20, SEQ ID NO: 142-173, or SEQ ID NO: 238-252 arranged in any combination or order.

A fragment of any of the above may retain the functional binding domains of the sensor or any functional therapeutic domains of the therapeutic. For example, a dual binding antibody protein complex can include the entire antibody or a fragment having regions of the antibody that are capable of binding to a marker and the therapeutic domain. In the latter case, the fragment may be an scFv that can bind to a marker and the therapeutic domain. Exemplary sequence of protein complexes of the present disclosure is shown below in TABLE 1.

TABLE 1

Exemplary Protein Complexes

| SEQ ID NO | Sequence | Description |
| --- | --- | --- |
| SEQ ID NO: 41 | MSTSTCDLPQTHSLGSRRTLMLLAQMRRISL FSCLKDRHDFGFPQEEFGNQFQKAETIPVLHE MIQQIFNLFSTKDSSAAWDETLLDKFYTELY QQLNDLEACVIQGVGVTETPLMKEDSILAVR KYFQRITLYLKEKKYSPCAWEVVRAEIMRSF SLSTNLQESLRSKEGGGGSGGGGSGGGGSGG GGSQVQLVQSGAEVKKPGASVKVSCKASGY TFSNYYVHWVRQAPGQGLEWMGWMDPNS GGTGYAHQFQGRVTMTRDTSTSTVYMELSS LRSEDTAVYYCAKEVFSGWYDYWGQGTLV TVSSASGGGGSGGGGSGGGGSHASDIQMTQS PSSLSASVGDRVTITCRASQSISSYLNWYQQK PGKAPKLLIYAASSLQSGVPSRFSGSGSGTDF TLTISSLQPEDFATYYCQQSYSTPYTFGQGTK VEIKGKPIPNPLLGLDST | Protein complex comprising a DBA/cytokine complex having a PD-L1/IFNα scFv sensor domain and an IFNα therapeutic domain scFv_IFN-Heavy_GS20_PDL1-IFN_1A05_H_I39V_S58P_Q69H_K70Q |

TABLE 1-continued

| Exemplary Protein Complexes | | |
|---|---|---|
| SEQ ID NO | Sequence | Description |
| SEQ ID NO: 42 | QVQLVQSGAEVKKPGASVKVSCKASGYTFT KNYMHWVRQAPGQGLEWLGWVSPDSGYTG YAQKFQGRVTMTRDTSTSTVYMELSSLRSED TAVYYCTTDLLSLELDDAFDIWGQGTMVTV SSASGGGGSGGGGSGGGGSHASDIQMTQSPS SLSASVGDRVTITCRASQSISSWLAWYQQKP GKAPKLLIYAASTLQSGVPSRFSGSGSGTDFT LTISSLQPEDFATYYCQQSYSTPLTFGGGTKL EIKPRGPTIKPCPPCKCPAPNAAGGPSVFIFPP KIKDVLMISLSPIVTCVVVDVSEDDPDVQISW FVNNVEVHTAQTQTHREDYNSTLRVVSALPI QHQDWMSGKEFKCKVNNKDLGAPIERTISKP KGSVRAPQVYVLPPCEEEMTKKQVTLSCAV TDFMPEDIYVEWTNNGKTELNYKNTEPVLDS DGSYFMVSKLRVEKKNWVERNSYSCSVVHE GLHNHHTTKSFSRTPGK | Protein complex comprising a DBA/cytokine complex having a PD-L1 antibody sensor domain and an IFNα therapeutic domain, where the DBA is an scFv PDL1-IFN_uIFN_2D10scFv_KiH_PDL1-IFN_1A05_H_N36G_Pep1 |
| SEQ ID NO: 43 | CDLPQTHSLGSRRTLMLLAQMRRISLFSCLK DRHDFGFPQEEFGNQFQKAETIPVLHEMIQQI FNLFSTKDSSAAWDETLLDKFCTELYQQLND LEACVMQEERVGETPLMNADSILAVKKYFR RITLYLTEKKYSPCAWEVVRAEIVRSLSLSTN LQERLRRKEGGGGSGGGGSGGGGSGGGGSQ VQLVQSGAEVKKPGASVKVSCKASGYTFSG YYIHWVRQAPGQGLEWMGWMDSNSGGTGY AQKFQGRVTMTRDTSTSTVYMELSSLRSEDT AVYYCAKEVFSGWYDYWGQGTLVTVSSAK TTAPSVYPLAPVCGDTTGSSVTLGCLVKGYF PEPVTLTWNSGSLSSGVHTFPAVLQSDLYTLS SSVTVTSSTWPSQSITCNVAHPASSTKVDKKI EPRGPTIKPCPPCKCPAPNAAGGPSVFIFPPKI KDVLMISLSPIVTCVVVDVSEDDPDVQISWF VNNVEVHTAQTQTHREDYNSTLRVVSALPIQ HQDWMSGKEFKCKVNNKDLGAPIERTISKPK GSVRAPQVCVLPPPEEEMTKKQVTLWCMVT DFMPEDIYVEWTNNGKTELNYKNTEPVLDS DGSYFMYSKLRVEKKNWVERNSYSCSVVHE GLHNHHTTKSFSRTPGK | First heavy chain of a protein complex comprising a DBA/cytokine complex having a PD-L1 binding domain and an IFNα therapeutic domain PDL1-IFN_uIFN_2D10scFv_KiH_PDL1-IFN_1A05_H_N36G_Pep2 |
| SEQ ID NO: 44 | DIQMTQSPSSLSASVGDRVTITCRASQSISSYL NWYQQKPGKAPKLLIYAASSLQSGVPSRFSG SGSGTDFTLTISSLQPEDFATYYCQQSYSTPY TFGQGTKVEIKRADAAPTVSIFPPSSEQLTSG GASVVCFLNNFYPKDINVKWKIDGSERQNG VLNSWTDQDSKDSTYSMSSTLTLTKDEYERH NSYTCEATHKTSTSPIVKSFNRNEC | Light chain of a protein complex comprising a DBA/cytokine complex having a PD-L1 scFv sensor domain and an IFNα therapeutic domain PDL1-IFN_uIFN_2D10scFv_KiH_PDL1-IFN_1A05_H_N36G_Pep3 |
| SEQ ID NO: 303 | QVQLVESGGGVVQPGRSLRLDCKASGITFSN SGMHWVRQAPGKGLEWVAVIWYDGSKRYY ADSVKGRFTISRDNSKNTLFLQMNSLRAEDT AVYYCATNDDYWGQGTLVTVSSAKTTAPSV YPLAPVCGDTTGSSVTLGCLVKGYFPEPVTL TWNSGSLSSGVHTFPAVLQSDLYTLSSSVTV TSSTWPSQSITCNVAHPASSTKVDKKIEPRGP TIKPCPPCKCPAPNAAGGPSVFIFPPKIKDVLM ISLSPIVTCVVVDVSEDDPDVQISWFVNNVEV HTAQTQTHREDYNSTLRVVSALPIQHQDWM SGKEFKCKVNNKDLGAPIERTISKPKGSVRAP QVYVLPPPEKEMTKKQVSLTCLVKDFMPEDI YVEWTNNGKTELNYKNTEPVLKSDGSYFMY SKLTVEKKNWVERNSYSCSVVHEGLHNHHT TKSFSRTPGGGGGSGGGGSGGGGSGGGGSQ VQLVQSGAEVKKPGASVKVSCKASGDTFTR YYVHWVRQAPGQGLEWMGIINPSGGYASYA QKFQGRVTMTRDTSTSTVYMELSSLRSEDTA VYYCAAGLFIWGQGTLVTVSSASGGGGSGG | PD1-IL2_3x_Cterm_Nivo_2B07_H_H37Y_L_A107Y_S109R; AF4505_pep2 |

TABLE 1-continued

Exemplary Protein Complexes

| SEQ ID NO | Sequence | Description |
|---|---|---|
| | GGSGGGGSHASDIQMTQSPSSLSASVGDRVTI<br>TCRASQSIGRWLAWYQQKPGKAPKLLIYSAS<br>NLETGVPSRFSGSGSGTDFTLTISSLQPEDFAT<br>YYCQQYNRFPVTFGPGTKVDIK | |
| SEQ ID NO:<br>304 | QVQLVESGGGVVQPGRSLRLDCKASGITFSN<br>SGMHWVRQAPGKGLEWVAVIWYDGSKRYY<br>ADSVKGRFTISRDNSKNTLFLQMNSLRAEDT<br>AVYYCATNDDYWGQGTLVTVSSAKTTAPSV<br>YPLAPVCGDTTGSSVTLGCLVKGYFPEPVTL<br>TWNSGSLSSGVHTFPAVLQSDLYTLSSSVTV<br>TSSTWPSQSITCNVAHPASSTKVDKKIEPRGP<br>TIKPCPPCKCPAPNAAGGPSVFIFPPKIDVLM<br>ISLSPIVTCVVVDVSEDDPDVQISWFVNNVEV<br>HTAQTQTHREDYNSTLRVVSALPIQHQDWM<br>SGKEFKCKVNNKDLGAPIERTISKPKGSVRAP<br>QVYVLPPPEKEMTKKQVSLTCLVKDFMPEDI<br>YVEWTNNGKTELNYKNTEPVLKSDGSYFMY<br>SKLTVEKKNWVERNSYSCSVVHEGLHNHHT<br>TKSFSRTPGGGGSGGGGSGGGGSGGGGSQ<br>VQLVQSGAEVKKPGASVKVSCKASGYTFTR<br>YYMHWVRQAPGQGLEWMGIINPRAGYTSY<br>ALKFQGRVTMTRDTSTSTVYMELSSLRSEDT<br>AVYYCTSGWDVWGQGTLVTVSSASGGGGS<br>GGGGSGGGGSHASDIQMTQSPSSLSASVGDR<br>VTITCRASQSISTWLAWYQQKPGKAPKLLIY<br>AASSLDSGVPSRFSGSGSGTDFTLTISSLQPED<br>FATYYCQQSYSFPVTFGQGTKVEIK | PD1-<br>IL2_3x_Cterm_Nivo_<br>704var<br>AF4504_pep2 |
| SEQ ID NO:<br>181 | APTSSSTKKTQLQLEHLLLDLQMILNGINNYK<br>NPKLTDMLTFEFYMPKKATELKHLQCLEREL<br>KPLEEVLNLAQSKNFHLRPRDLISNINVIVLEL<br>KGSETTFMCEYADETATIVEFLNRWITFCQSII<br>STLTGGGGSGGGGSGGGGSGGGGSQVQLVQ<br>SGAEVKKPGASVKVSCKASGDTFTRYYVHW<br>VRQAPGQGLEWMGIINPSGGYASYAQKFQG<br>RVTMTRDTSTSTVYMELSSLRSEDTAVYYCA<br>AGLFIWGQGTLVTVSSAKTTAPSVYPLAPVC<br>GDTTGSSVTLGCLVKGYFPEPVTLTWNSGSL<br>SSGVHTFPAVLQSDLYTLSSSVTVTSSTWPSQ<br>SITCNVAHPASSTKVDKKIEPRGPTIKPCPPCK<br>CPAPNAAGGPSVFIFPPKIDVLMISLSPIVTC<br>VVVDVSEDDPDVQISWFVNNVEVHTAQTQT<br>HREDYNSTLRVVSALPIQHQDWMSGKEFKC<br>KVNNKDLGAPIERTISKPKGSVRAPQVYVLPP<br>PEEEMTKKQVTLTCMVTDFMPEDIYVEWTN<br>NGKTELNYKNTEPVLDSDGSYFMYSDLRVE<br>KKNWVERNSYSCSVVHEGLHNHHTTESFSR<br>TPGK | PD1-<br>IL2_3x_Asym_PD1-<br>IL2_2B07_H_H37Y_L_<br>W38Y_A107Y |
| SEQ ID NO:<br>182 | QVQLVQSGAEVKKPGASVKVSCKASGDTFTRYYVHWV<br>RQAPGQGLEWMGIINPSGGYASYAQKFQGRVTMTRD<br>TSTSTVYMELSSLRSEDTAVYYCAAGLFIWGQGTLVTVS<br>SAKTTAPSVYPLAPVCGDTTGSSVTLGCLVKGYFPEPVT<br>LTWNSGSLSSGVHTFPAVLQSDLYTLSSSVTVTSSTWPS<br>QSITCNVAHPASSTKVDKKIEPRGPTIKPCPPCKCPAPN<br>AAGGPSVFIFPPKIDVLMISLSPIVTCVVVDVSEDDPDV<br>QISWFVNNVEVHTAQTQTHREDYNSTLRVVSALPIQH<br>QDWMSGKEFKCKVNNKDLGAPIERTISKPKGSVRAPQ<br>VYVLPPPEKEMTKKQVSLTCLVKDFMPEDIYVEWTNN<br>GKTELNYKNTEPVLKSDGSYFMYSKLTVEKKNWVERNS<br>YSCSVVHEGLHNHHTTKSFSRTPGGGSGGGSHHHHH<br>H | PD1-<br>IL2_3x_Asym_PD1-<br>IL2_2B07_H_H37Y_L_<br>W38Y_A107Y |
| SEQ ID NO:<br>183 | APTSSSTKKTQLQLEHLLLDLQMILNGINNYKNPKLTDM<br>LTFEFYMPKKATELKHLQCLERELKPLEEVLNLAQSKNF<br>HLRPRDLISNINVIVLELKGSETTFMCEYADETATIVEFLN<br>RWITFCQSIISTLTGGGGSGGGGSGGGGSGGGGSQVQ<br>LVQSGAEVKKPGASVKVSCKASGYTFTDYYMHWVRQ<br>APGQGLEWMGIINPRAGYTSYALKFQGRVTMTRDTST<br>STVYMELSSLRSEDTAVYYCTSGWDVWGQGTLVTVSS<br>AKTTAPSVYPLAPVCGDTTGSSVTLGCLVKGYFPEPVTL<br>TWNSGSLSSGVHTFPAVLQSDLYTLSSSVTVTSSTWPS<br>QSITCNVAHPASSTKVDKKIEPRGPTIKPCPPCKCPAPN<br>AAGGPSVFIFPPKIDVLMISLSPIVTCVVVDVSEDDPDV<br>QISWFVNNVEVHTAQTQTHREDYNSTLRVVSALPIQH | PD1-<br>IL2_3x_Asym_PD1-<br>IL2_7A04_H_M115W_L_<br>Q68D |

TABLE 1-continued

Exemplary Protein Complexes

| SEQ ID NO | Sequence | Description |
|---|---|---|
| | QDWMSGKEFKCKVNNKDLGAPIERTISKPKGSVRAPQ<br>VYVLPPPEEEMTKKQVTLTCMVTDFMPEDIYVEWTNN<br>GKTELNYKNTEPVLDSDGSYFMYSDLRVEKKNWVERN<br>SYSCSVVHEGLHNHHTTESFSRTPGK | |
| SEQ ID NO: 184 | QVQLVQSGAEVKKPGASVKVSCKASGYTFTDYYMHW<br>VRQAPGQGLEWMGIINPRAGYTSYALKFQGRVTMTR<br>DTSTSTVYMELSSLRSEDTAVYYCTSGWDVWGQGTLV<br>TVSSAKTTAPSVYPLAPVCGDTTGSSVTLGCLVKGYFPE<br>PVTLTWNSGSLSSGVHTFPAVLQSDLYTLSSSVTVTSST<br>WPSQSITCNVAHPASSTKVDKKIEPRGPTIKPCPPCKCP<br>APNAAGGPSVFIFPPKIKDVLMISLSPIVTCVVVDVSED<br>DPDVQISWFVNNVEVHTAQTQTHREDYNSTLRVVSAL<br>PIQHQDWMSGKEFKCKVNNKDLGAPIERTISKPKGSVR<br>APQVYVLPPPEKEMTKKQVSLTCLVKDFMPEDIYVEWT<br>NNGKTELNYKNTEPVLKSDGSYFMYSKLTVEKKNWVE<br>RNSYSCSVVHEGLHNHHTTKSFSRTPGGGGSGGGSHH<br>HHHH | PD1-<br>IL2_3x_Asym_PD1-<br>IL2_7A04_H_M115W_L_<br>Q68D |

A. Sensor Domains

Protein complexes of the present disclosure include sensor domains. A sensor domain may be any protein that is capable of sensing the presence of a first moiety and regulating a second moiety, where the first moiety is a marker (e.g., a tumor cell marker) and the second moiety is a therapeutic domain (e.g., a cytokine therapeutic domain). For example, the present disclosure provides a sensor domain that may be an antibody or antibody fragment capable of binding a first moiety and binding and blocking the activity of a second moiety, wherein the first moiety is a marker (e.g., a tumor marker) and the second moiety is a therapeutic domain (e.g., a cytokine therapeutic domain). In the absence of the first moiety, the sensor domain binds the second moiety. If the first moiety is introduced into the system, the sensor domain binds the first moiety and unbinds the second moiety. Thus, the binding and unbinding of the second moiety is reversible. The sensor domain inactivates or blocks the activity of the therapeutic domain by binding the therapeutic domain and preventing it from binding to its target (e.g., a receptor, a ligand, or a substrate). The sensor domain regulates the therapeutic domain by releasing it to act on its target upon binding of a marker.

In some embodiments, the sensor domain is a dual binding protein such as a dual binding antibody. A dual binding protein may be capable of binding the marker and the therapeutic domain. A dual binding protein of the present disclosure may be selected or engineered to bind the marker and the therapeutic domain. The dual binding protein may have a higher affinity for the marker as compared to the therapeutic domain. The dual binding protein may be affinity matured to have a higher affinity for the marker as compared to the therapeutic domain.

In some embodiments, the sensor domain is an antibody. The sensor domain may also be a fragment of an antibody. A fragment of an antibody consistent with the sensor domains disclosed herein retains its ability to exhibit dual binding to both a marker and a therapeutic domain. One or both domains of a bispecific antibody may be sensor domains of the protein complexes of the present disclosure. In the instance that bispecific antibodies are used, the bispecific antibody may include a first antigen binding domain that may bind a therapeutic domain and a marker and may also include a second antigen binding domain capable of binding the marker. In some embodiments, the bispecific antibody may have a first antigen binding domain that binds a therapeutic domain and a first marker, and a second antigen binding domain that binds a second marker. In some embodiments, the bispecific antibody may have a first antigen binding domain that binds a therapeutic domain and a first marker, and a second antigen binding domain that binds a therapeutic domain and a second marker. In some embodiments the first and second antigen binding domains may bind to the same therapeutic domain (FIG. 13).

In some embodiments the two sensor domains may bind to a single IFNα domain attached by a linker to two antibody domains; a first antibody domain that may bind to CEA (a first marker) and to the IFNα domain, and a second antibody domain that may bind to ATP (a second marker), and to the IFNα domain such that the IFNα is able to bind its receptor only in the presence of CEA and ATP (FIG. 13).

In some embodiments, the sensor domain is an anti-PD1 or anti-PDL1 antibody or fragment thereof (e.g., an scFv that binds PD1 or PD-L1). In some embodiments, the sensor domain binds to a marker comprising a surface protein, such as a cell surface protein, soluble ATP, a secreted protein, PD1, PD-L1, CEACAM5, FAP, LRRC15, a metabolite, adenosine, AMP, ADP, ATP, or kynurenine, or CRIPTO, CD19, CD20, CD22, CD30, CD33, Glycoprotein NMB, CanAg, HER2 (ErbB2/Neu), CD56 (NCAM), CD70, CD79, CD138, PSCA, PSMA (prostate specific membrane antigen), BCMA, E-selectin, EphB2, Melanotransferin, Muc16 and TMEFF2, BMPR1B, E16, STEAP1, 0772P, MPF, Napi3b, Sema 5b, PSCA hlg, ETBR, MSG783, STEAP2, TrpM4, CD21, CD79b, FcRH2, NCA, MDP, IL20Rα, Brevican, EphB2R, ASLG659, PSCA, GEDA, BAFF-R, CD79a, CXCR5, HLA-DOB, P2X5, CD72, FCRHI, IRTA2, a sialic acid, or any other marker described in U.S. Pat. No. 10,561,739, incorporated herein by reference in its entirety or WO 2005/082023, incorporated herein by reference in its entirety.

In some embodiments, the sensor domain comprises a condition-dependent target affinity. Many cell types, including a range of cancer cell types, generate specific extracellular and tissue-specific microenvironments distinct from those of healthy cells. Recently, significant attention has been placed on the link between extracellular sodium depletion and certain brain cancers. As a further example, some cancers generate low pH microenvironments which can affect changes in the membranome protonation and conformational patterns. Accordingly, a sensor domain may comprise enhanced affinity for a target marker in the presence of a particular condition. A sensor domain may be responsive to pH, temperature, salinity, osmotic pressure, or any combination thereof. For example, a sensor domain may comprise an order of magnitude greater affinity for a target molecule or an order of magnitude lower affinity for a therapeutic domain in the presence of a particular condition. The particular condition may affect the sensor (e.g., a charge or conformation of the sensor), the target (e.g., a charge or solubility of the target), or both.

B. Therapeutic Domains

Protein complexes of the present disclosure include therapeutic domains. A therapeutic domain of the present disclosure is linked to a sensor domain via a linker to form a protein complex. The therapeutic domain may exert therapeutic activity by binding to a target. For example, the therapeutic domain may be a cytokine and its target may be a receptor target. Upon binding of the cytokine to its receptor target, the cytokine may modulate cellular proliferation, activation, differentiation, and/or may exert anti-tumor or anti-viral activity. Therapeutic domains consistent with the protein complexes of the present disclosure include a cytokine, a chemokine, an antibody, an antibody fragment, a peptide agonist, a peptide antagonist, an enzyme, a soluble receptor, a growth factor, a protein toxin, a soluble ligand, a small molecule, or combinations thereof. In some embodiments, an antibody or antibody fragment comprises an IgG, an IgA, an IgD, an IgE, an IgM, an Fab, an F(ab)'2, a single domain antibody fragment (e.g., a nanobody), a diabody, an scFab, an scFv, an (scFv)$_2$, or any fragment (e.g., an Fc domain or CH domain) or combination thereof.

In some embodiments, the protein complexes of the present disclosure comprise a therapeutic domain comprising an IL-2 receptor agonist, IL-12 receptor agonist, or IFNα, or variants or fusions of these cytokines. In some embodiments, the therapeutic domain may be IFNα, IFNγ IL-12 IL-4, IL-8, IL-10, IL-15, IL-18, IL-21, TGF beta, an anti-CD3 antibody, an anti-CD28 antibody or ligand, an antibody to or ligand of CD40, GITR, OX40, CD137, CD27, or Death Receptors, the extracellular domain of TGFBR2, VEGF-C, kynureninase, IL-7, TNF, MICA, MICB, CD47, an anti-CTLA4 antibody, an anti-PD-L1 antibody, or an anti-PD-1 antibody. The therapeutic domain may also be a fragment of any of the above mentioned moieties. A fragment retains functional regions of the moiety needed for binding to its target (e.g., IL-2 receptor) and any functional regions needed for activity.

C. Linkers

A protein complex disclosed herein may comprise a linker. The linker may connect two domains, such as a sensor domain and a therapeutic domain. The linker may connect two portions of a sensor domain, for example a light chain variable domain and a heavy chain variable domain. Various linkers are consistent with the protein complexes of the present disclosure. In some embodiments, the linker may be an amino acid linker or a chemical linker.

The linker may be a stable linker. For example, a linker may maintain a connection between a therapeutic domain and a sensor domain even upon binding of the sensor domain to a marker and, thereby, unbinding of the therapeutic domain from the sensor domain. For example, although the sensor domain may unbind the therapeutic domain, the therapeutic domain may remain linked to the sensor domain via the linker. Examples of linkers that are consistent with this activity may include non-cleavable linkers.

The linker may also be a flexible linker. A flexible linker is a linker that is long enough to allow for the therapeutic domain to bind to its target, once it is unbound from the sensor domain. Flexibility of the linker may affect therapeutic efficacy. For example, upon binding of the sensor domain to a marker and unbinding of the therapeutic domain, the therapeutic domain needs to be able to encounter and bind its therapeutic target (e.g., a receptor on the same cell surface as the marker or a receptor on an adjacent cell surface to the marker). If the linker is not flexible enough to allow for the therapeutic domain to binds its therapeutic target, therapeutic efficacy may be reduced or not exerted. When the linker is flexible, therapeutic domains may be able to bind their therapeutic target and exert high therapeutic efficacy. Flexibility of a linker may arise from the length of the linker. For example, short linkers may sterically hinder the therapeutic domain from binding its target. Longer linkers may allow for the protein complex to be more flexible and allow for therapeutic domains to bind their target. In some embodiments, a linker that is too long may impact the ability of the sensor domain to bind the therapeutic domain and inhibit activity in the absence of the marker. In some embodiments, a linker that is too long may impact the stability of a protein therapeutic domain or the half-life of the protein therapeutic domain in vivo.

In some embodiments, the linker may be attached to a heavy chain of the sensor domain or a light chain of the sensor domain. A linker may be fused to the N-terminus or C-terminus of the sensor domain. In some embodiments, the linker may be attached to a heavy chain or light chain of the therapeutic domain or is fused with the N-terminus or C-terminus of the therapeutic domain. For example, a linker may be attached to an N-terminus or C-terminus of an scFV or an ScFab.

Amino Acid Linkers. An amino acid linker may comprise any amino acid residues. In some embodiments, favored amino acid residues are amino acid residues that are entropically flexible. Favored amino acid residues in an amino acid linker of the present disclosure may include glycine and serine. Other preferred amino acid residues may include alanine, proline, threonine, and glutamic acid. In preferred embodiments, the amino acid linker may comprise from 3 to 60 amino acid residues in length. In some embodiments, the amino acid linker may comprise 20 amino acid residues. In some embodiments, the amino acid linker may comprise 40 amino acid residues. In some embodiments, the amino acid linker may comprise 60 amino acid residues. In some embodiments, the amino acid linker may comprise 80 amino acid residues. An amino acid linker may comprise at least 5 amino acid residues. An amino acid linker may comprise at least 10 amino acid residues. An amino acid linker may comprise at least 15 amino acid residues. An amino acid linker may comprise at least 20 amino acid residues. An amino acid linker may comprise at least 25 amino acid residues. An amino acid linker may comprise at least 30 amino acid residues. An amino acid linker may comprise at least 35 amino acid residues. An amino acid linker may comprise at least 40 amino acid residues. An amino acid linker may comprise at least 45 amino acid residues. An amino acid linker may comprise at least 50 amino acid residues. An amino acid linker may comprise at least 55 amino acid residues. An amino acid linker may comprise at least 60 amino acid residues. An amino acid linker may comprise at least 65 amino acid residues. An amino acid linker may comprise at least 70 amino acid residues. An amino acid linker may comprise at least 75 amino acid residues. An amino acid linker may comprise at least 80 amino acid residues. An amino acid linker may comprise at least 85 amino acid residues. An amino acid linker may comprise at least 90 amino acid residues. An amino acid linker may comprise at least 95 amino acid residues. An amino acid linker may comprise at least 100 amino acid residues. An amino acid linker may comprise at least 110 amino acid residues. An amino acid linker may comprise at least 120 amino acid residues. An amino acid linker may comprise at least 130 amino acid residues. An amino acid linker may comprise at least 140 amino acid residues. An amino acid linker may comprise at least 150 amino acid residues. An amino acid linker may comprise at least 160 amino acid residues. An amino acid linker may comprise at least 170 amino acid residues. An amino acid linker may comprise at least 180 amino acid residues. An amino acid linker may comprise at least 190 amino acid residues. An amino acid linker may comprise at least 200 amino acid residues. An amino acid linker may comprise at least 300 amino acid residues. An amino acid linker may comprise at least 400 amino acid residues. An amino acid linker may comprise at least 500 amino acid residues. An amino acid linker may comprise from 5 to 10 amino acid residues. An amino acid linker may comprise from 10 to 15 amino acid residues. An amino acid linker may comprise from 15 to 20 amino acid residues. An amino acid linker may comprise from 20 to 25 amino acid residues. An amino acid linker may comprise from 25 to 30 amino acid residues. An amino acid linker may comprise from 30 to 35 amino acid residues. An amino acid linker may comprise from 35 to 40 amino acid residues. An amino acid linker may comprise from 40 to 45 amino acid residues. An amino acid linker may comprise from 45 to 50 amino acid residues. An amino acid linker may comprise from 50 to 55 amino acid residues. An amino acid linker may comprise from 55 to 60 amino acid residues. An amino acid linker may comprise from 60 to 65 amino acid residues. An amino acid linker may comprise from 65 to 70 amino acid residues. An amino acid linker may comprise from 70 to 75 amino acid residues. An amino acid linker may comprise from 75 to 80 amino acid residues. An amino acid linker may comprise from 80 to 85 amino acid residues. An amino acid linker may comprise from 85 to 90 amino acid residues. An amino acid linker may comprise from 90 to 95 amino acid residues. An amino acid linker may comprise from 95 to 100 amino acid residues. An amino acid linker may comprise from 5 to 80 amino acid residues. An amino acid linker may comprise from 20 to 40 amino acid residues. An amino acid linker may comprise from 20 to 80 amino acid residues. An amino acid linker may comprise from 30 to 60 amino acid residues. An amino acid linker may comprise from 40 to 50 amino acid residues. An amino acid linker may comprise from 10 to 30 amino acid residues. An amino acid linker may comprise from 10 to 20 amino acid residues. An amino acid linker may comprise from 5 to 25 amino acid residues. An amino acid linker may comprise from 25 to 75 amino acid residues. An amino acid linker may comprise from 100 to 500 amino acid residues. An amino acid linker may comprise from 100 to 300 amino acid residues. An amino acid linker may comprise from 5 to 500 amino acid residues. An amino acid linker may comprise no more than 100 amino acid residues. An amino acid linker may comprise no more than 90 amino acid residues. An amino acid linker may comprise no more than 80 amino acid residues. An amino acid linker may comprise no more than 70 amino acid residues. An amino acid linker may comprise no more than 60 amino acid residues. An amino acid linker may comprise no more than 50 amino acid residues. An amino acid linker may comprise no more than 40 amino acid residues. An amino acid linker may comprise no more than 30 amino acid residues. An amino acid linker may comprise no more than 20 amino acid residues. An amino acid linker may comprise no more than 10 amino acid residues. An amino acid linker may comprise no more than 95 amino acid residues. An amino acid linker may comprise no more than 90 amino acid residues. An amino acid linker may comprise no more than 85 amino acid residues. An amino acid linker may comprise no more than 80 amino acid residues. An amino acid linker may comprise no more than 75 amino acid residues. An amino acid linker may comprise no more than 70 amino acid residues. An amino acid linker may comprise no more than 65 amino acid residues. An amino acid linker may comprise no more than 60 amino acid residues. An amino acid linker may comprise no more than 55 amino acid residues. An amino acid linker may comprise no more than 50 amino acid residues. An amino acid linker may comprise no more than 45 amino acid residues. An amino acid linker may comprise no more than 40 amino acid residues. An amino acid linker may comprise no more than 35 amino acid residues. An amino acid linker may comprise no more than 30 amino acid residues. An amino acid linker may comprise no more than 25 amino acid residues. An amino acid linker may comprise no more than 20 amino acid residues. An amino acid linker may comprise no more than 15 amino acid residues. An amino acid linker may comprise no more than 10 amino acid residues. An amino acid linker may comprise no more than 200 amino acid residues. An amino acid linker may comprise no more than 300 amino acid residues. An amino acid linker may comprise no more than 400 amino acid residues. An amino acid linker may comprise no more than 500 amino acid residues.

Non-Cleavable Linkers.

A non-cleavable linker of the present disclosure may include a chemical linker that is stable. Examples of non-cleavable linkers consistent for use in protein complexes of the present disclosure to link the sensor domain and the therapeutic domain may include a thioether linker, an alkyl linker, a polymeric linker. A linker may be an SMCC linker or a PEG linker. In preferred embodiments, the linker may be a PEG linker.

A non-cleavable linker may also include a non-proteolytically cleavable peptide. A non-proteolytically cleavable peptide may be inert to proteases present in a given sample or organism. For example, a peptide may be inert to all human protease cleavage sequences, and thereby may comprise a high degree of stability within humans and human samples. Such a peptide may also comprise a secondary structure which renders a protease cleavage site inert or inaccessible to a protease. A non-cleavable linker of the present disclosure may comprise a half-life for cleavage of at least 1 hour, at least 2 hours, at least 4 hours, at least 8 hours, at least 12 hours, at least 16 hours, at least 1 day, at least 2 days, at least 3 days, at least 1 week, at least 2 weeks, or at least 1 month in the presence of human proteases at 25° C. in pH 7 buffer.

D. Protein Complex Structures

The present disclosure provides a wide variety of protein complexes spanning a range of structures. A protein complex of the present disclosure may comprise a therapeutic domain and a sensor domain expressed as a single unit. A therapeutic domain may be expressed as an N-terminal extension of a sensor domain, as a C-terminal extension of a sensor domain, or disposed within a sensor domain. For example, a protein complex may comprise a peptide which comprises, from N-terminus to C-terminus, a therapeutic domain, a peptide linker, an scFv domain, and optionally a tag, such as a purification tag (e.g., a V5 or myc tag) or a localization signal. Alternatively, a therapeutic domain and a sensor domain may be coupled (e.g., chemically coupled) subsequent to expression.

A protein complex may comprise a plurality of protein subunits. The plurality of protein subunits (e.g., a therapeutic domain and a sensor domain, two sensor domains, or two subunits of a sensor domain) may be chemically or physically coupled following expression. The plurality of protein subunits may comprise a plurality of sensor and/or therapeutic domains. A sensor and/or a therapeutic domain may be comprised of a single protein subunit, of multiple protein subunits, or by portions thereof. For example, a sensor domain may comprise an antibody Fab region comprising portions of an immunoglobulin light chain and an immunoglobulin heavy chain.

A plurality of protein subunits may comprise physical handles which facilitate their selective coupling. The physical handles may enable spontaneous, irreversible, and/or non-mediated (e.g., not requiring a chaperone protein or a catalytic complex) coupling between the protein subunits, thereby enabling complex and asymmetric protein complexes. For example, two distinct protein complex subunits expressed in a single Chinese hamster ovary (CHO) cell, may comprise physical handles which spontaneously and irreversibly couple prior to cellular export. Such physical handles may comprise a 'knob-into-hole' (KIH) construct or a charge-swap construct, in which two protein subunits comprise physical structures with mutual binding affinities and specificities. Such physical handles may comprise a covalently binding pair, such as a plurality of thiols configured to form disulfide bonds. Physical handles may enable facile production of protein complexes comprising identical or distinct domains.

A protein complex may comprise two or more identical domains. An example of such a protein complex is provided in FIG. 14A, which illustrates an antibody (multi-sensor domain) coupled to two IL-2 therapeutic domains. In this example, the protein complex comprises two protein immunoglobulin light chain subunits and two immunoglobulin heavy chain subunits complexed to form a competent antibody. The two immunoglobulin heavy chain subunits comprise N-terminal linkers coupled to IL-2 therapeutic domains. Each immunoglobulin heavy chain is coupled to an immunoglobulin light chain, such that the protein complex comprises two Fab regions, each separately coupled to a therapeutic domain by a linker.

Figure 9A:
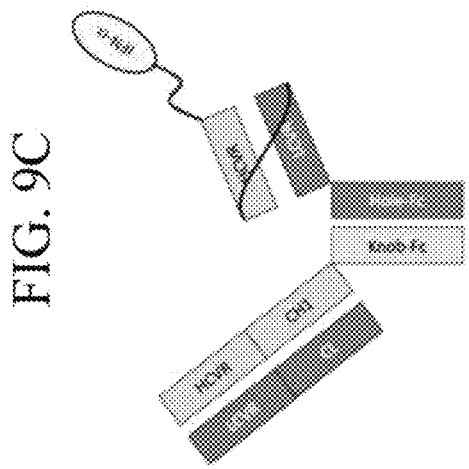
FIGS. 9A-F show schematics of other protein complexes of the present disclosure comprising one or more sensor domains and one or more therapeutic domain.
Figure 9B:
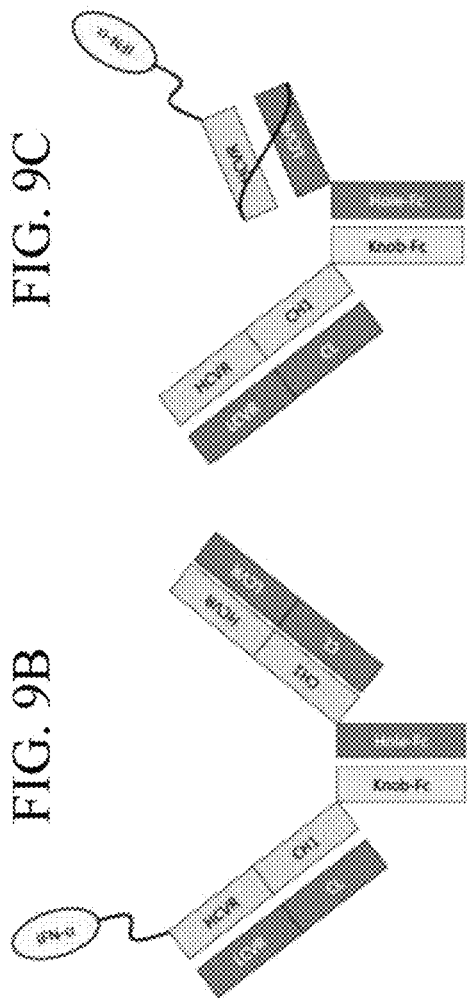
Figure 9C:
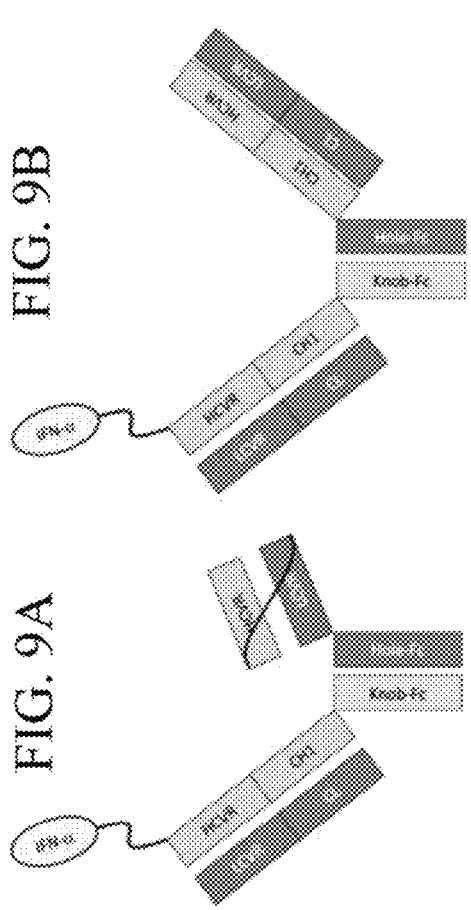

While the above example provides a symmetric protein complex with two identical sensor domains and two identical therapeutic domains, a protein complex may also comprise a plurality of distinct sensor and/or therapeutic domains. Such a protein complex may comprise an immunoglobulin unit with a first arm comprised of a heavy chain-light chain pair, and a second arm comprised of an antibody fragment such as an scFv, an scFab, a VH, or a fragment thereof. In such cases, the heavy chain, the antibody fragment, or the light chain may comprise an N-terminal extension with a linker and a therapeutic domain, as illustrated in FIGS. 9A, C, and F, respectively. Alternatively, the heavy chain, the antibody fragment, or the light chain may comprise a C-terminal extension with a linker and a therapeutic domain. A protein complex may also comprise a symmetric immunoglobulin unit with a single therapeutic domain. For example, as shown in FIG. 9B, an immunoglobulin unit may comprise an N-terminal linker and therapeutic unit on a single heavy chain. Alternatively, an immunoglobulin unit may comprise an N-terminal linker and therapeutic unit on a single light chain. An immunoglobulin unit may also comprise a pair of antibody fragments coupled to a single Fc region. An immunoglobulin unit may comprise a nanobody. An immunoglobulin unit may comprise a diabody.

In some cases, a plurality of distinct sensor domains are associated with a plurality of distinct therapeutic domains. Such a plurality of sensor domains may comprise common targets. For example, a protein complex may comprise a first sensor domain associated with an IL-2 therapeutic domain and comprising affinities for IL-2 and PD-1, and a second sensor domain associated with an IFNα therapeutic domain and comprising an affinity for IFNα and PD-1. Alternatively, a plurality of sensor domains may comprise separate targets. For example, a protein complex may comprise a first sensor domain associated with an IL-2 therapeutic domain and comprising affinities for IL-2 and PD-1, and a second sensor domain associated with an IFNα therapeutic domain and comprising an affinity for IFNα and CEACAM5.

Figure 13A:
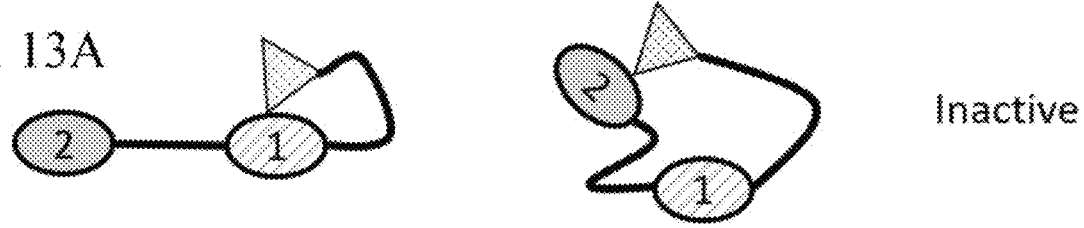
FIGS. 13A-C show a schematic of a bispecific antibody comprising a therapeutic domain and two sensor domains such that both sensor domains must bind their target marker to allow activity of the therapeutic domain.
Figure 13B:
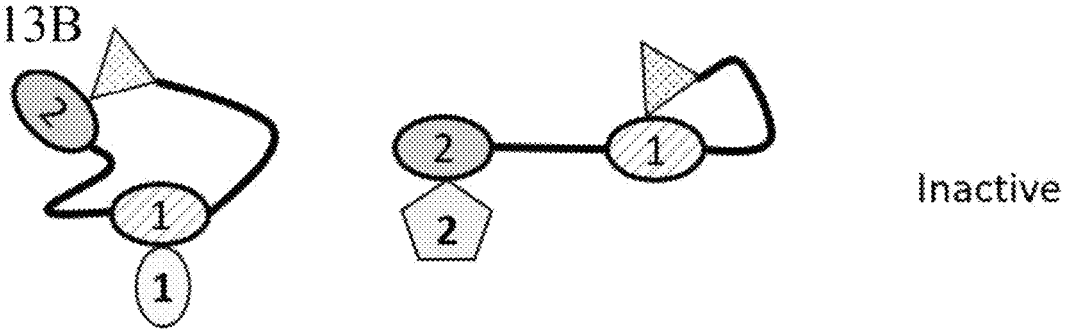
Figure 13C:
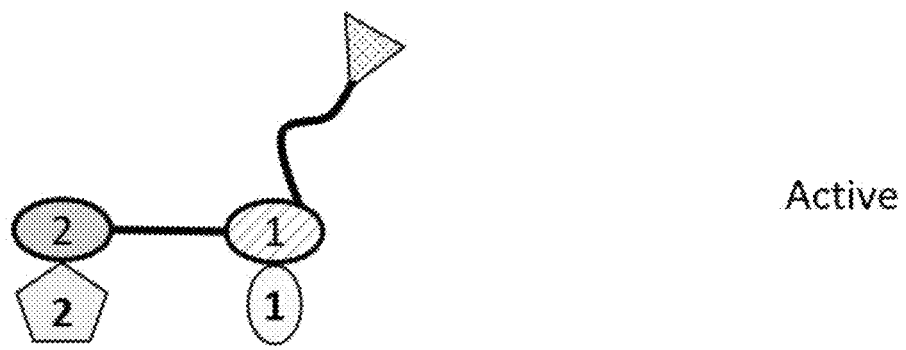

A protein complex may comprise a therapeutic domain targeted by one or more than one sensor domain. A protein complex comprising such a plurality of sensor domains may comprise a multi-target dependence for activity. This concept is illustrated in FIGS. 13A-13C, which provides a protein complex comprising a therapeutic domain, a first sensor domain targeting the therapeutic domain and a first target ('Marker 1'), and a second sensor domain targeting the therapeutic domain and a second target ('Marker 2'). In this example, the presence of Marker 1 leads to therapeutic domain binding to DBA 2, while the presence of Marker 2 leads to therapeutic domain binding to DBA 1. However, the presence of Marker 1 and Marker 2 liberates the therapeutic domain, enhancing its activity. Accordingly, the activity of the protein complex is requisite upon the presence of both of its markers. An example of such a system may be a protein complex comprising a first sensor domain which targets IL-2 and PD-1, and a second sensor domain which targets IL-2 and CEACAM5, such that CEACAM5 and PD-1 are requisite for IL-2 activity by the protein complex. A protein complex may comprise a dependence for at least 2, at least 3, at least 4, or at least 5 target markers. A protein complex may comprise a dependence for at most 5, at most 4, at most 3, at most 2, or for a single target marker.

Multi-marker activity dependence may enhance the selectivity of a protein complex. Some cells, including many forms of cancerous cells, comprise minor variations in their surfaceomes relative to healthy cells, rendering monospecific targeting unfeasible for distinguishing diseased cells. Accordingly, selectively targeting a particular diseased cell or tissue may require targeting a plurality of markers. A protein complex of the present disclosure may target at least 2, at least 3, at least 4, or at least 5 markers. A protein complex of the present disclosure may target at most 5, at most 4, at most 3, or at most 2 markers. In some cases, at least one of the markers targeted by a protein complex is commonly shared between a target cell or tissue and a healthy cell or tissue. In some cases, all of the markers targeted by a protein complex are commonly shared between a target cell or tissue and a healthy cell or tissue.

A sensor domain of the present disclosure may target at least 2, at least 3, at least 4, at least 5, at least 6, at least 7, at least 8, at least 9, or at least 10 markers and no therapeutic domain. A sensor domain of the present disclosure may target at most 2, at most 3, at most 4, at most 5, at most 6, at most 7, at most 8, at most 9, or at most 10 markers and no therapeutic domain. A sensor domain of the present disclosure may target a single therapeutic domain and at least 1, at least 2, at least 3, at least 4, at least 5, at least 6, at least 7, at least 8, at least 9, or at least 10 markers. A sensor domain of the present disclosure may target a single therapeutic domain and at most 1, at most 2, at most 3, at most 4, at most 5, at most 6, at most 7, at most 8, at most 9, or at most 10 markers. A sensor domain of the present disclosure may target at least two therapeutic domains and at least 1, at least 2, at least 3, at least 4, at least 5, at least 6, at least 7, at least 8, at least 9, or at least 10 markers. A sensor domain of the present disclosure may target at least two therapeutic domains and at most 1, at most 2, at most 3, at most 4, at most 5, at most 6, at most 7, at most 8, at most 9, or at most 10 markers.

Two sensor domains may comprise identical affinities for a therapeutic domain, or may comprise different affinities for the therapeutic domain. Two sensor domains may comprise affinities for a therapeutic domain differing by at least 1 order of magnitude, at least 2 orders of magnitude, at least 3 orders of magnitude, or at least 4 orders of magnitude for a therapeutic domain. Two sensor domains may comprise affinities for a therapeutic domain which differ by at most 4 orders of magnitude, at most 3 orders of magnitude, at most 2 orders of magnitude, or at most 1 order of magnitude. A combination of different therapeutic domain affinities by a plurality of sensor domains may enhance the affinity of a protein complex for a target marker. For example, a protein complex may comprise a first sensor domain which weakly targets a first cell surface marker and weakly targets a therapeutic domain, and a second sensor domain which strongly targets a second cell surface marker and strongly targets the therapeutic domain, such that the protein complex exhibits weak activity in the presence of the cell surface second marker and strong activity in the presence of the first and the second cell surface markers.

Two sensor domains of a protein complex may also target separate therapeutic domains. For example, a protein complex may comprise a first sensor domain which targets IL-2 and PD-1, and a second sensor domain which targets IFNα and CEACAM5. A protein complex may comprise a sensor domain which does not target a therapeutic domain. Such a sensor domain may aid in target localization, or may enhance the activity of a separate sensor domain for a therapeutic domain. An example of a protein complex comprising a sensor domain which does not target a therapeutic domain is provided in FIG. 14C. This system comprises a monospecific anti-PD-1 antibody, wherein a first heavy chain comprises a C-terminal linker coupled to a therapeutic domain, and a second heavy chain comprises a C-terminal linker coupled to a sensor domain with dual specificity for the therapeutic domain and for a target marker.

A protein complex may comprise a single target, 2 targets, 3 targets, 4 targets, or more than 4 targets. A protein complex may comprise at least 2 targets, at least 3 targets, or at least 4 targets. A protein complex may comprise at most 4 targets, at most 3 targets, or at most 2 targets. A protein complex may comprise a single sensor domain, 2 sensor domains, 3 sensor domains, 4 sensor domains, or more than 4 sensor domains. A protein complex may comprise at least 2 sensor domains, at least 3 sensor domains, or at least 4 sensor domains. For example, a protein complex may comprise an IgM antibody comprising Fab region sensor domains, or an IgA antibody comprising 4 Fab region sensor domains.

A protein complex may comprise a range of sensor-to-therapeutic domain ratios. A protein complex may comprise equal numbers of sensor domains and therapeutic domains, examples of which are provided by FIG. 14A, which illustrates a protein complex with 2 sensor domains and 2 therapeutic domains, and FIG. 8, which illustrates a protein complex with a single sensor domain and a single therapeutic domain. A protein complex may comprise a greater number of sensor domains than therapeutic domains, such as the protein complexes of FIGS. 9A, 9B, 9C, 9F, and 14B, which each comprise two sensor domains and one therapeutic domain. In such cases, a therapeutic domain may be capable of interacting with multiple sensor domains, or may be constrained from interacting with more than one sensor domain. The number of therapeutic domains with which a sensor domain may interact may depend on its linker. A linker may be sufficiently short so as to prevent a therapeutic domain from interacting with a sensor domain, or may be sufficiently long so as to allow a therapeutic domain to interact with multiple sensor domains.

In specific cases, a protein complex may comprise an antibody with Fc-coupled therapeutic and sensor domains. As illustrated in FIG. 14C, a protein complex may comprise an antibody with a first heavy chain C-terminal extension comprising a linker and a therapeutic domain, and a second heavy chain C-terminal extension comprising a linker and a sensor domain. An antibody of this design may comprise common targets across its Fab and C-terminal extension sensor domain. For example, the antibody Fab regions and C-terminal extension sensor domain may each target PD-1. Conversely, an antibody of this design may comprise separate targets across its Fab regions and C-terminal extension sensor domain.

In some embodiments, an amino acid in the protein complex described herein may comprise a conservative substitution. A conservative substitution may comprise a substitution of one amino acid with a different amino acid with similar biochemical properties (e.g. charge, hydrophobicity, and size). Examples of conservative substitutions, as well as substitutions that may be, but are not necessarily, preferred, are provided in TABLE 33.

TABLE 33

Exemplary Conservative Substitutions

| Original Residue | Exemplary Substitutions | Preferred Substitutions |
|---|---|---|
| Ala (A) | Val; Leu; Ile | Val |
| Arg (R) | Lys; Gln; Asn | Lys |
| Asn (N) | Gln; His; Lys; Arg | Gln |
| Asp (D) | Glu | Glu |
| Cys (C) | Ser | Ser |
| Gln (Q) | Asn | Asn |
| Glu (E) | Asp | Asp |
| Gly (G) | Pro; Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln; Asn | Arg |
| Met (M) | Leu; Phe; Ile | Leu |
| Phe (F) | Leu; Val; Ile; Ala; Tyr | Leu |
| Pro (P) | Ala | Ala |
| Ser (S) | Thr | Thr |
| Thr (T) | Ser | Ser |
| Trp (W) | Tyr; Phe | Tyr |
| Tyr (Y) | Trp; Phe; Thr; Ser | Phe |
| Val (V) | Ile; Leu; Met; Phe; Ala; Norleucine | Leu |

In some embodiments, the present disclosure describes a recombinant nucleic acid that encodes the protein complex disclosed herein. In some embodiments, the recombinant nucleic acid comprises a plasmid or a vector that encodes the entire protein complex. In some embodiments, the recombinant nucleic acid comprises plasmids or vectors that encode the therapeutic domain, the sensor domain, and the linker respectively. In some embodiments, the recombinant nucleic acid comprises plasmids or vectors that encode any two of the therapeutic domain, the sensor domain, and the linker together.

Pharmaceutical Formulations

A protein complex or a recombinant nucleic acid encoding the protein complex of the present disclosure may be formulated as a pharmaceutical composition. A pharmaceutical composition may comprise a pharmaceutically acceptable carrier or excipient. As used herein "pharmaceutically acceptable" or "pharmacologically acceptable" includes molecular entities and compositions that do not produce an adverse, allergic or other untoward reaction when administered to a subject, as appropriate. "Pharmaceutically acceptable carrier" includes any and all solvents, dispersion media, coatings, antibacterial and antifungal agents, isotonic and absorption delaying agents and the like. The use of such media and agents for pharmaceutical active substances is well known in the art. Except insofar as any conventional media or agent is incompatible with the active ingredient, its use in the therapeutic compositions is contemplated. Supplementary active ingredients are often also incorporated into the compositions.

Applications

A protein complex of the present disclosure may be used for various therapeutic applications. A protein complex of the present disclosure may be used as a therapeutic to administer to a subject in need thereof. The subject may be a human or non-human mammal. The subject may have a disease. The disease may be cancer. The cancer may be acute lymphoblastic leukemia (ALL); acute myeloid leukemia (AML); cancer in adolescents; adrenocortical carcinoma; aids-related cancers; kaposi sarcoma (soft tissue sarcoma); aids-related lymphoma (lymphoma); primary cns lymphoma (lymphoma); anal cancer; appendix cancer—see gastrointestinal carcinoid tumors; astrocytomas, childhood (brain cancer); atypical teratoid/rhabdoid tumor, childhood, central nervous system (brain cancer); basal cell carcinoma of the skin—see skin cancer; bile duct cancer; bladder cancer; bone cancer (includes ewing sarcoma and osteosarcoma and malignant fibrous histiocytoma); brain tumors; breast cancer; bronchial tumors (lung cancer); burkitt lymphoma—see non-hodgkin lymphoma; carcinoid tumor (gastrointestinal); carcinoma of unknown primary; cardiac (heart) tumors, childhood; central nervous system; atypical teratoid/rhabdoid tumor, childhood (brain cancer); medulloblastoma and other cns embryonal tumors, childhood (brain cancer); germ cell tumor, childhood (brain cancer); primary cns lymphoma; cervical cancer; childhood cancers; cancers of childhood, unusual; cholangiocarcinoma—see bile duct cancer; chordoma, childhood (bone cancer); chronic lymphocytic leukemia (CLL); chronic myelogenous leukemia (CMIL); chronic myeloproliferative neoplasms; colorectal cancer; craniopharyngioma, childhood (brain cancer); cutaneous t-cell lymphoma—see lymphoma (mycosis fungoides and sezary syndrome); ductal carcinoma in situ (DCIS)—see breast cancer; embryonal tumors, medulloblastoma and other central nervous system, childhood (brain cancer); endometrial cancer (uterine cancer); ependymoma, childhood (brain cancer); esophageal cancer; esthesioneuroblastoma (head and neck cancer); ewing sarcoma (bone cancer); extracranial germ cell tumor, childhood; extragonadal germ cell tumor; eye cancer; intraocular melanoma; retinoblastoma; fallopian tube cancer; fibrous histiocytoma of bone, malignant, and osteosarcoma; gallbladder cancer; gastric (stomach) cancer; gastrointestinal carcinoid tumor; gastrointestinal stromal tumors (GIST) (soft tissue sarcoma); germ cell tumors; childhood central nervous system germ cell tumors (brain cancer); childhood extracranial germ cell tumors; extragonadal germ cell tumors; ovarian germ cell tumors; testicular cancer; gestational trophoblastic disease; hairy cell leukemia; head and neck cancer; heart tumors, childhood; hepatocellular (liver) cancer; histiocytosis, langerhans cell; hodgkin lymphoma; hypopharyngeal cancer (head and neck cancer); intraocular melanoma; islet cell tumors, pancreatic neuroendocrine tumors; kaposi sarcoma (soft tissue sarcoma); kidney (renal cell) cancer; langerhans cell histiocytosis; laryngeal cancer (head and neck cancer); leukemia; lip and oral cavity cancer (head and neck cancer); liver cancer; lung cancer (non-small cell, small cell, pleuropulmonary blastoma, and tracheobronchial tumor); lymphoma; male breast cancer; malignant fibrous histiocytoma of bone and osteosarcoma; melanoma; melanoma, intraocular (eye); merkel cell carcinoma (skin cancer); mesothelioma, malignant; metastatic cancer; metastatic squamous neck cancer with occult primary (head and neck cancer); midline tract carcinoma with nut gene changes; mouth cancer (head and neck cancer); multiple endocrine neoplasia syndromes; multiple myeloma/plasma cell neoplasms; mycosis fungoides (lymphoma); myelodysplastic syndromes, myelodysplastic/myeloproliferative neoplasms; myelogenous leukemia, chronic (CML); myeloid leukemia, acute (AML); myeloproliferative neoplasms, chronic; nasal cavity and paranasal sinus cancer (head and neck cancer); nasopharyngeal cancer (head and neck cancer); neuroblastoma; non-hodgkin lymphoma; non-small cell lung cancer; oral cancer, lip and oral cavity cancer and oropharyngeal cancer (head and neck cancer); osteosarcoma and malignant fibrous histiocytoma of bone; ovarian cancer; pancreatic cancer; pancreatic neuroendocrine tumors (islet cell tumors); papillomatosis (childhood laryngeal); paraganglioma; paranasal sinus and nasal cavity cancer (head and neck cancer); parathyroid cancer; penile cancer; pharyngeal cancer (head and neck cancer); pheochromocytoma; pituitary tumor; plasma cell neoplasm/multiple myeloma; pleuropulmonary blastoma (lung cancer); pregnancy and breast cancer; primary central nervous system (CNS) lymphoma; primary peritoneal cancer; prostate cancer; rectal cancer; recurrent cancer; renal cell (kidney) cancer; retinoblastoma; rhabdomyosarcoma, childhood (soft tissue sarcoma); salivary gland cancer (head and neck cancer); sarcoma; childhood rhabdomyosarcoma (soft tissue sarcoma); childhood vascular tumors (soft tissue sarcoma); ewing sarcoma (bone cancer); kaposi sarcoma (soft tissue sarcoma); osteosarcoma (bone cancer); soft tissue sarcoma; uterine sarcoma; Sezary syndrome (lymphoma); skin cancer; small cell lung cancer; small intestine cancer; soft tissue sarcoma; squamous cell carcinoma of the skin—see skin cancer; squamous neck cancer with occult primary, metastatic (head and neck cancer); stomach (gastric) cancer; t-cell lymphoma, cutaneous—see lymphoma (mycosis fungoides and Sezary syndrome); testicular cancer; throat cancer (head and neck cancer); nasopharyngeal cancer; oropharyngeal cancer; hypopharyngeal cancer; thymoma and thymic carcinoma; thyroid cancer; tracheobronchial tumors (lung cancer); transitional cell cancer of the renal pelvis and ureter (kidney (renal cell) cancer); unknown primary carcinoma; unusual cancers of childhood; ureter and renal pelvis, transitional cell cancer (kidney (renal cell) cancer); urethral cancer; uterine cancer, endometrial; uterine sarcoma; vaginal cancer; vascular tumors (soft tissue sarcoma); vulvar cancer; Wilms tumor and other childhood kidney tumors; or cancer in young adults or any cancer mentioned at https://www.cancer.gov/types.

In addition to the treatment of cancer, the protein complexes of the present disclosure have potential applications in a variety of other settings where targeted, conditional activity may be advantageous. In autoimmune and inflammatory disease, therapeutics that act through global immune suppression have the disadvantage of leaving patients more susceptible to a variety of opportunistic infections. Additionally, the short half-life and lack of accumulation in disease tissues may limit the efficacy of immune-dampening recombinant cytokines. The protein complexes of the present disclosure may address these shortcomings by allowing targeted delivery of immune modulators including IL-4, IL-10, TGF-β, and TNFR2 selectively to affected anatomical locations while remaining silent in the periphery. Additional applications may include cell type-specific therapeutic targeting, such Treg cell-directed IL-2. Targeted, conditional activation of opioid agonists in specific organs or in the presence of markers of inflammation may reduce the addictive risk of pain control.

A protein complex may be administered as a pharmaceutical composition. A pharmaceutical composition of the disclosure can be a combination of any protein complex described herein with other chemical components, such as carriers, stabilizers, diluents, dispersing agents, suspending agents, thickening agents, and/or excipients. The pharmaceutical composition facilitates administration of a protein complex described herein to an organism. Pharmaceutical compositions can be administered in therapeutically-effective amounts as pharmaceutical compositions by various forms and routes including, for example, intravenous, subcutaneous, intramuscular, rectal, aerosol, parenteral, ophthalmic, pulmonary, transdermal, vaginal, optic, nasal, oral, inhalation, dermal, intra-articular, intrathecal, intranasal, and topical administration. A pharmaceutical composition can be administered in a local or systemic manner, for example, via injection of the protein complex described herein directly into an organ, optionally in a depot.

Parenteral injections can be formulated for bolus injection or continuous infusion. The pharmaceutical compositions can be in a form suitable for parenteral injection as a sterile suspension, solution or emulsion in oily or aqueous vehicles, and can contain formulatory agents such as suspending, stabilizing and/or dispersing agents. Pharmaceutical formulations for parenteral administration include aqueous solutions of a protein complex described herein in water-soluble form. Suspensions of protein complexes described herein can be prepared as oily injection suspensions. Suitable lipophilic solvents or vehicles include fatty oils such as sesame oil, or synthetic fatty acid esters, such as ethyl oleate or triglycerides, or liposomes. Aqueous injection suspensions can contain substances which increase the viscosity of the suspension, such as sodium carboxymethyl cellulose, sorbitol, or dextran. The suspension can also contain suitable stabilizers or agents which increase the solubility and/or reduces the aggregation of such protein complexes described herein to allow for the preparation of highly concentrated solutions. Alternatively, the protein complexes described herein can be lyophilized or in powder form for re-constitution with a suitable vehicle, e.g., sterile pyrogen-free water, before use. In some embodiments, a purified protein complex is administered intravenously. A protein complex of the present disclosure may comprise a sufficiently long serum half life (e.g., as demonstrated in EXAMPLE 17) to enable dosing regimens comprising daily, alternating day, twice weekly, weekly, biweekly, or monthly dosing frequencies. A protein complex of the present disclosure may comprise a serum half-life of at least 12 hours, at least 24 hours, at least 36 hours, at least 48 hours, at least 72 hours, at least 96 hours, at least 120 hours, at least 168 hours, at least 250 hours, at least 320 hours, or at least 400 hours. The serum half-life may be a human serum half-life, a murine serum half-life, a porcine serum-half life, a bovine serum half-life, a canine serum half-life, a feline serum half-life, or a leporine serum half-life.

A protein complex of the disclosure can be applied directly to an organ, or an organ tissue or cells, during a surgical procedure, or via transdermal, subcutaneous, intramuscular, intratumoral, intrathecal, topical, or local delivery. In some embodiments, a protein complex of the present disclosure may be injected directly into the synovium (e.g., for administration of a protein complex comprising IL-10 for rheumatoid arthritis). In some embodiments, a protein complex may be applied directly to a cancerous tissue (e.g., a tumor). The protein complexes described herein can be administered topically and can be formulated into a variety of topically administrable compositions, such as solutions, suspensions, lotions, gels, pastes, medicated sticks, balms, creams, and ointments. Such pharmaceutical compositions can contain solubilizers, stabilizers, tonicity enhancing agents, buffers and preservatives.

In practicing the methods of treatment or use provided herein, therapeutically-effective amounts of the protein complex described herein are administered in pharmaceutical compositions to a subject suffering from a condition. In some instances the pharmaceutical composition will affect the physiology of the animal, such as the immune system, inflammatory response, or other physiologic affect. In some embodiments, the subject is a mammal such as a human. A therapeutically-effective amount can vary widely depending on the severity of the disease, the age and relative health of the subject, the potency of the compounds used, and other factors.

Pharmaceutical compositions can be formulated using one or more physiologically-acceptable carriers comprising excipients and auxiliaries, which facilitate processing of the active compounds into preparations that can be used pharmaceutically. Formulation can be modified depending upon the route of administration chosen. Pharmaceutical compositions comprising a protein complex described herein can be manufactured, for example, by expressing the protein complex in a recombinant system, purifying the protein complex, lyophilizing the protein complex, mixing, or dissolving. The pharmaceutical compositions can include at least one pharmaceutically acceptable carrier, diluent, or excipient and compounds described herein as free-base or pharmaceutically-acceptable salt form.

Methods for the preparation of protein complexes described herein include formulating the protein complex described herein with one or more inert, pharmaceutically-acceptable excipients or carriers to form a solid, semi-solid, or liquid composition. Solid compositions include, for example, powders, tablets, dispersible granules, capsules, cachets, and suppositories. These compositions can also contain minor amounts of nontoxic, auxiliary substances, such as wetting or emulsifying agents, pH buffering agents, and other pharmaceutically-acceptable additives.

Certain methods described herein comprise administering to the subject an intravenous pharmaceutical composition comprising a protein complex of the present disclosure, for example, as described herein. Intravenous pharmaceutical compositions of protein complexes include any formulation suitable for administration to a subject via any intravenous method, including a bolus, an infusion which occurs over time or any other intravenous method known in the art. In some aspects, the rate of infusion is such that the dose is administered over a period of less than five minutes, more than five minutes but less than 15 minutes or greater than 15 minutes. In other aspects, the rate of infusion is such that the dose is administered over a period of less than 5 minutes. In other aspects, the rate of infusion is such that the dose is administered over a period of greater than 5 minutes and less than 15 minutes. In some other aspects, the rate of infusion is such that the dose is administered over a period of greater than 15 minutes.

"Product" or "dosage form" as used herein refers to any solid, semi-solid, lyophilized, aqueous, liquid or frozen formulation or preparation used for administration. Upon administration, the rate of release of an active moiety from a product is often greatly influenced by the excipients and/or product characteristics which make up the product itself. For example, an enteric coat on a tablet is designed to separate that tablet's contents from the stomach contents to prevent, for example, degradation of the stomach which often induces gastrointestinal discomfort or injury. According to the currently accepted conventional understanding, systemic exposure of the active moiety will be relatively insensitive to the small formulation changes.

Non-limiting examples of pharmaceutically-acceptable excipients can be found, for example, in Remington: The Science and Practice of Pharmacy, Nineteenth Ed (Easton, Pa.: Mack Publishing Company, 1995); Hoover, John E., Remington's Pharmaceutical Sciences, Mack Publishing Co., Easton, Pa. 1975; Liberman, H. A. and Lachman, L., Eds., Pharmaceutical Dosage Forms, Marcel Decker, New York, N.Y., 1980; and Pharmaceutical Dosage Forms and Drug Delivery Systems, Seventh Ed. (Lippincott Williams & Wilkins 1999), each of which is incorporated by reference in its entirety.

A protein complex of the present disclosure may be administered to a patient in an effective amount. The term "effective amount," as used herein, can refer to a sufficient amount of an agent or a compound being administered which will relieve to some extent one or more of the symptoms of the disease or condition being treated. The result can be reduction and/or alleviation of the signs, symptoms, or causes of a disease, or any other desired alteration of a biological system. Compositions containing such agents or compounds can be administered for prophylactic, enhancing, and/or therapeutic treatments. An appropriate "effective" amount in any individual case can be determined using techniques, such as a dose escalation study.

The methods, compositions, and kits of this disclosure can comprise a method to prevent, treat, arrest, reverse, or ameliorate the symptoms of a condition. The treatment can comprise treating a subject (e.g., an individual, a domestic animal, a wild animal or a lab animal afflicted with a disease or condition) with a protein complex of the disclosure. Protein complexes of the present disclosure may be administered to treat a disease in a subject. The subject can be a human. A subject can be a human; a non-human primate such as a chimpanzee, or other ape or monkey species; a farm animal such as a cattle, horse, sheep, goat, swine; a domestic animal such as a rabbit, dog, and cat; a laboratory animal including a rodent, such as a rat, mouse and guinea pig, or the like. A subject can be of any age. A subject can be, for example, an elderly adult, adult, adolescent, pre-adolescent, child, toddler, infant, or fetus in utero.

Treatment can be provided to the subject before clinical onset of disease. Treatment can be provided to the subject after clinical onset of disease. Treatment can be provided to the subject after 1 day, 1 week, 6 months, 12 months, or 2 years or more after clinical onset of the disease. Treatment may be provided to the subject for more than 1 day, 1 week, 1 month, 6 months, 12 months, 2 years or more after clinical onset of disease. Treatment may be provided to the subject for less than 1 day, 1 week, 1 month, 6 months, 12 months, or 2 years after clinical onset of the disease. Treatment can also include treating a human in a clinical trial. A treatment can comprise administering to a subject a pharmaceutical composition, such as one or more of the pharmaceutical compositions described throughout the disclosure. A treatment can comprise a once daily dosing. A treatment can comprise delivering a protein complex of the disclosure to a subject, either intravenously, subcutaneously, intramuscularly, by inhalation, dermally, intra-articular injection, orally, intrathecally, transdermally, intranasally, via a peritoneal route, or directly onto or into a diseased tissue, e.g., via topical, intra-articular injection route or injection route of application.

In some embodiments, the present disclosure provides a method for treating a cancer, the method comprising administering to a subject in need thereof an effective amount of a protein complex of the present disclosure.

In some embodiments, the present disclosure provides a method for treating a cancer, the method comprising administering to a patient in need thereof an effective amount of a pharmaceutical composition comprising a protein complex of the present disclosure and a pharmaceutically acceptable carrier.

Kits

A protein complex of the present disclosure may be provided in various kits. In some embodiments, pharmaceutical compositions comprising a protein complex of the present disclosure may be supplied as a kit. A kit may comprise a container that comprises a protein complex. Therapeutic protein complexes can be provided in the form of an injectable solution for single or multiple doses, or as a sterile powder that will be reconstituted before injection. Alternatively, such a kit can include a dry-powder disperser, liquid aerosol generator, or nebulizer for administration of a therapeutic protein complexes. Such a kit may further comprise written information on indications and usage of the pharmaceutical composition.

Unless otherwise defined, all technical terms used herein have the same meaning as commonly understood by one of ordinary skill in the art to which this invention belongs. As used in this specification and the appended claims, the singular forms "a," "an," and "the" include plural references unless the context clearly dictates otherwise. Any reference to "or" herein is intended to encompass "and/or" unless otherwise stated.

Whenever the term "at least," "greater than," or "greater than or equal to" precedes the first numerical value in a series of two or more numerical values, the term "at least," "greater than" or "greater than or equal to" applies to each of the numerical values in that series of numerical values. For example, greater than or equal to 1, 2, or 3 is equivalent to greater than or equal to 1, greater than or equal to 2, or greater than or equal to 3.

Whenever the term "no more than," "less than," "less than or equal to," or "at most" precedes the first numerical value in a series of two or more numerical values, the term "no more than," "less than" or "less than or equal to," or "at most" applies to each of the numerical values in that series of numerical values. For example, less than or equal to 3, 2, or 1 is equivalent to less than or equal to 3, less than or equal to 2, or less than or equal to 1.

Where values are described as ranges, it will be understood that such disclosure includes the disclosure of all possible sub-ranges within such ranges, as well as specific numerical values that fall within such ranges irrespective of whether a specific numerical value or specific sub-range is expressly stated.

EXAMPLES

The following examples are illustrative and non-limiting to the scope of the devices, methods, systems, and kits described herein.

Example 1

Selection of IFNα and PD-L1 Specific Dual Binding Antibodies (DBAs)

This example describes isolation of sensor domains of the present disclosure, specifically, selection of IFNα and PD-L1 specific dual binding antibodies (DBAs). Anti-PD-L1 and anti-IFNα DBAs were isolated from a Tumbler antibody phage display library (Distributed Bio, Inc.). The antibody phage display library was constructed to incorporate the heavy chain CDR1, heavy chain CDR2, and light chain diversity of the Superhuman 2.0 antibody library combined with 10 heavy chain ("HC") CDR3 sequences (SEQ ID NO: 1-SEQ ID NO: 10) from the PD-L1 binding antibodies described, as shown below in TABLE 2.

TABLE 2

HC-CDR3 of PD-L1 binders

| SEQ ID NO | Sequence | Description |
|---|---|---|
| SEQ ID NO: 1 | CARDRIAVAGFDYW | HC-CDR3 of PD-L1 binder |
| SEQ ID NO: 2 | CAKEVFSGWYDYW | HC-CDR3 of PD-L1 binder |
| SEQ ID NO: 3 | CTTDLLSLELDDAFDIW | HC-CDR3 of PD-L1 binder |
| SEQ ID NO: 4 | CARSLFPTIFGVEVAFDIW | HC-CDR3 of PD-L1 binder |
| SEQ ID NO: 5 | CARDSYYYDSFDYW | HC-CDR3 of PD-L1 binder |
| SEQ ID NO: 6 | CARHGEWGSGWPFDYW | HC-CDR3 of PD-L1 binder |
| SEQ ID NO: 7 | CARDLLPAIFSGEVNDAFDIW | HC-CDR3 of PD-L1 binder |
| SEQ ID NO: 8 | CARETIAVAGFDPW | HC-CDR3 of PD-L1 binder |
| SEQ ID NO: 9 | CARDVLPTIFGVVSDAFDIW | HC-CDR3 of PD-L1 binder |
| SEQ ID NO: 10 | CARGDYGDYFDYW | HC-CDR3 of PD-L1 binder |

The library was subjected to four rounds of selection alternating between PD-L1 (to develop the PD-L1 binding, where PD-L1 serves as a marker) and IFNα (to develop IFNα binding, where IFNα is the therapeutic domain regulated by the sensor domain). Each round the phage library was incubated with the antigen (PD-L1 or IFNα), captured on magnetic beads, washed on a Kingfisher magnetic particle processor, eluted from the magnetic beads, and amplified by passaging in *E. coli*. In Round 1, the phage library was incubated with 50 nM of a human PD-L1-Fc fusion (R&D Systems, Prod. Num. 156-B7) and captured on protein G magnetic beads. In Round 2, the phage library was incubated with 100 nM of biotinylated human IFNα (Genscript, Prod. Num. Z03003, biotinylated using standard protocols) and captured on streptavidin magnetic beads. In Round 3, the phage library was incubated with 50 nM of a cynomolgus PD-L1-Fc fusion and captured on protein G magnetic beads. In Round 4, the phage library was incubated with 50 nM of biotinylated human IFNα and captured on streptavidin magnetic beads. The final selection was plated as single colonies and 380 colonies were picked for Sanger sequencing. Forty-one unique clones were chosen for expression. The scFv sequence for each clone was codon-optimized for *E. coli* expression and the corresponding DNA sequences synthesized as gBlocks (Integrated DNA Technologies, Inc.) with a T7 promoter, a translation initiation site, a Myc tag, the scFv sequence, a V5 tag sequence, and a T7 terminator. If the framework sequence of the antibody variable regions differed from the germline sequence, a second version of the clone was synthesized with the germline sequence. An exemplary sequence of a gBlock expression fragment is shown in

FIG. 3
(SEQ ID NO: 40,

GCGAATTAATACGACTCACTATAGGGCTTAAGTATAAGGAGAATAATAT

ATGTCTACTTCAACAGAACAAAAGTTAATTAGTGAAGAAGATTTACAGG

TCCAGTTGGTTCAGTCAGGCGCAGAAGTCAAAAAGCCGGGAGCGAGTGT

CAAAGTATCTTGTAAAGCGAGCGGTGGTACTTTTAGTAGTTATGCGATT

-continued
TCCTGGGTTCGCCAAGCCCCGGGACAGGGTCTGGAATGGATGGGTATTA

TTGACCCTTCCGTGACTTACACCCGCTACGCTCAGAAATTCCAGGGACG

TGTTACCATGACCCGCGATACCAGCACCAGTACCGTTTACATGGAACTT

TCCTCCCTGAGATCGGAAGACACGGCCGTGTATTATTGCGCTCGCTCAC

TCTTTCCGACCATCTTCGGCGTTGAAGTCGCCTTCGACATCTGGGGCCA

GGGCACGCTGGTTACGGTAAGTTCCGCAAGTGGCGGTGGTGGTAGTGGT

GGAGGTGGATCAGGAGGAGGTGGTTCTCACGCATCAGACATTCAAATGA

CACAGAGTCCATCATCCCTTTCTGCCTCCGTGGGTGACCGGGTGACGAT

-continued

```
AACCTGCCAAGCTAGCCAAGACATTAGCAACTATCTGAACTGGTACCAG

CAAAAGCCTGGGAAAGCTCCGAAACTATTGATTTACGGTGCGTCGACTC

TCCAGAGTGGGGTACCTAGTCGTTTTTCCGGTTCAGGGTCGGGTACAGA

TTTTACCCTTACTATTTCCTCTCTGCAGCCAGAAGACTTTGCTACTTAT

TACTGCCAACAGACTTATTCGACTCCGATTACGTTTGGCCAGGGAACCA

AAGTCGAAATCAAAGGCAAGCCGATCCCGAACCCTCTGCTGGGATTAGA

CAGCACGTAACTAGCATAACCCCTCTCTAAACGGAGGGGTTT).
```

Proteins from each of the gBlock fragments were expressed using a cell-free transcription/translation system (Cosmo Bio USA, Inc., PUREfrex2.1, Product #GFK-PF213 with DS Supplement, Prod. #GFK-PFof5).

The cell-free expression samples containing V5-tagged scFvs were serially diluted in a 384-well plate. Alexa Fluor 647-labeled anti-V5 antibody was added to each well along with Eu-labeled IFNα 2a or PD-L. Plates were incubated at room temperature for 2 hours and the HTRF signal was read on an Envision (Perkin Elmer) equipped with an HTRF laser module. To examine the ability of DBA binding domains to block Interferon alpha Receptor 2 (dFNAR2) binding to IFNα, V5-tagged DBA scFvs were synthesized using the PUREfrex 2.1 in vitro translation system and serially diluted in a 384 well plate. Eu-labeled IFNα was added to each well along with IFNAR2-Fc and an APC-labeled anti-Fc antibody. Plates were incubated at room temperature for 2 hours, and the HTRF signal was read on an Envision (Perkin Elmer) as a measure of IFNα:IFNAR2 binding. Fluorescence signal values from the binding and inhibition curves is summarized in TABLE 4 and binding curves for IFNα and PD-L1 are shown in FIG. 4 and FIG. 5, respectively. IFNAR2 blocking curves are shown in FIG. 6. DBAs having sequences of SEQ TD NO: 21-SEQ TD NO: 27 were able to bind both IFNα (FIG. 4) and PD-L1 (FIG. 5). SEQ TD NO: 24 blocked binding of IFNα to IFNAR2, and SEQ TD NO: 26 reduced binding of IFNα to IFNAR2 (FIG. 6).

TABLE 3

DBAs and Controls

| SEQ ID NO | Sequence | Description |
|---|---|---|
| SEQ ID NO: 21 | QVQLVQSGAEVKKPGASVKVSCKASGYTF SNYYIHWVRQAPGQGLEWMGWMDSNSG GTGYAQKFQGRVTMTRDTSTSTVYMELSS LRSEDTAVYYCAKEVFSGWYDYWGQGTL VTVSSASGGGGSGGGGSGGGGSHASDIQM TQSPSSLSASVGDRVTITCRASQSISSYLNW YQQKPGKAPKLLIYAASSLQSGVPSRFSGS GSGTDFTLTISSLQPEDFATYYCQQSYSTPY TFGQGTKVEIK | DBA capable of binding a PD-L1 marker and IFNα therapeutic domain |
| SEQ ID NO: 22 | QVQLVQSGAEVKKPGASVKVSCKASGGTF SSYAISWVRQAPGQGLEWVGWMDPKSGN TGYAQKFQGRVTMTRDTSTSTVYMELSSL RSEDTAVYYCARSLFPTIFGVEVAFDIWGQ GTLVTVSSASGGGGSGGGGSGGGGSHASD IQMTQSPSSLSASVGDRVTITCQASQDINNY LNWYQQKPGKAPKLLIYKASSLEPGVPSRF SGSGSGTDFTLTISSLQPEDFATYYCQKSND VPFTFGQGTKVEIK | DBA capable of binding a PD-L1 marker and IFNα therapeutic domain |
| SEQ ID NO: 23 | QVQLVQSGAEVKKPGASVKVSCKASGGTF SSYYMHWVRQAPGQGLEWMGWMNPNSG NTGYAQKFQGRVTMTRDTSTSTVYMELSS LRSEDTAVYYCARSLFPTIFGVEVAFDIWG QGTLVTVSSASGGGGSGGGGSGGGGSHAS DIQMTQSPSSLSASVGDRVTITCQASQDITN YLNWYQQKPGKAPKLLIYAASSLESGVPSR FSGSGSGTDFTLTISSLQPEDFATYYCQQSY SIPITFGQGTRLEIK | DBA capable of binding a PD-L1 marker and IFNα therapeutic domain |
| SEQ ID NO: 24 | QVQLVQSGAEVKKPGASVKVSCKASGGTF TGYYMHWVRQAPGQGLEWMGWVNPNSG NTGYAQKFQGRVTMTRDTSTSTVYMELSS LRSEDTAVYYCARSLFPTIFGVEVAFDIWG QGTLVTVSSASGGGGSGGGGSGGGGSHAS DIQMTQSPSSLSASVGDRVTITCQASQDISN YLNWYQQKPGKAPKLLIYAASSLQSGVPS RFSGSGSGTDFTLTISSLQPEDFATYYCQQS YSPPPTFGQGTKLEIK | DBA capable of binding a PD-L1 marker and IFNα therapeutic domain |
| SEQ ID NO: 25 | QVQLVQSGAEVKKPGASVKVSCKASGNTF TDYYMHWVRQAPGQGLEWMGWMNPNS GNTGYAQKFQGRVTMTRDTSTSTVYMELS SLRSEDTAVYYCARSLFPTIFGVEVAFDIW GQGTLVTVSSASGGGGSGGGGSGGGGSHA SDIQMTQSPSSLSASVGDRVTITCQASQDIS NYLNWYQQKPGKAPKLLIYAASSLQSGVP SRFSGSGSGTDFTLTISSLQPEDFATYYCQQ SYSTPPTFGQGTRLEIK | DBA capable of binding a PD-L1 marker and IFNα therapeutic domain |

TABLE 3-continued DBAs and Controls

| SEQ ID NO | Sequence | Description |
|---|---|---|
| SEQ ID NO: 26 | QVQLVQSGAEVKKPGASVKVSCKASGGTFSSYAISWVRQAPGQGLEWMGIIDPSVTYTRYAQKFQGRVTMTRDTSTSTVYMELSSLRSEDTAVYYCARSLFPTIFGVEVAFDIWGQGTLVTVSSASGGGGSGGGGSGGGGSHASDIQMTQSPSSLSASVGDRVTITCQASQDISNYLNWYQQKPGKAPKLLIYGASTLQSGVPSRFSGSGSGTDFTLTISSLQPEDFATYYCQQTYSTPITFGQGTKVEIK | DBA capable of binding a PD-L1 marker and IFNα therapeutic domain |
| SEQ ID NO: 27 | QVQLVQSGAEVKKPGASVKVSCKASGGTFSSYAISWVRQAPGQGLEWMGWMDANNGNTGYAQKFQGRVTMTRDTSTSTVYMELSSLRSEDTAVYYCARSLFPTIFGVEVAFDIWGQGTLVTVSSASGGGGSGGGGSGGGGSHASDIQMTQSPSSLSASVGDRVTITCRASQSVSSYLNWYQQKPGKAPKLLIYKASSLESGVPSRFSGSGSGTDFTLTISSLQPEDFATYYCQQSSSTPLSFGGGTKVEIK | DBA capable of binding a PD-L1 marker and IFNα therapeutic domain |
| SEQ ID NO: 28 | EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASGGGGSGGGGSGGGGSHASDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIK | Anti-HER2 control |
| SEQ ID NO: 29 | EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSAASGGGGSGGGGSGGGGSHASDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK | Anti-PD-L1 control |
| SEQ ID NO: 30 | EVQLVESGGGLVQPGGSLRLSCATSGYTFTEYIIHWVRQAPGKGLEWVASINPDYDITNYNQRFKGRFTISLDKSKRTAYLQMNSLRAEDTAVYYCASWISDFFDYWGQGTLVTVSSASGGGGSGGGGSGGGGSHASDIQMTQSPSSLSASVGDRVTITCRASQSVSTSSYSYMHWYQQKPGKAPKVLISYASNLESGVPSRFSGSGSGTDFTLTISSLQPEDFATYYCQHSWGIPRTFGQGTKVEIK | Anti-IFNα control |

TABLE 4

Fluorescence Signal Values from Binding and Inhibition Curves

| Name | PDL1 Binding | IFNα Binding | IFNAR2-IFN binding |
|---|---|---|---|
| PDL1-IFN-R01-A03 | 2,715 | 20,447 | 42,528 |
| PDL1-IFN-R01-A04 | 2,377 | 10,890 | 45,590 |
| PDL1-IFN-R01-A05 (SEQ ID NO: 21) | 3,113 | 7,115 | 50,505 |
| PDL1-IFN-R01-A06 (SEQ ID NO: 22) | 2,781 | 8,563 | 44,019 |
| PDL1-IFN-R01-A07 | 3,010 | 4,496 | 52,343 |
| PDL1-IFN-R01-A08 | 2,274 | 19,905 | 40,314 |
| PDL1-IFN-R01-A09 | 1,628 | 6,585 | 50,070 |
| PDL1-IFN-R01-A09V2 | 1,894 | 5,264 | 49,709 |
| PDL1-IFN-R01-A10 | 1,969 | 6,105 | 48,781 |
| PDL1-IFN-R01-A11 (SEQ ID NO: 23) | 2,965 | 14,613 | 41,796 |
| PDL1-IFN-R01-A12 | 2,133 | 9,478 | 53,273 |
| PDL1-IFN-R01-B01 | 3,172 | 7,460 | 44,230 |
| PDL1-IFN-R01-B02 | 2,695 | 7,190 | 42,135 |
| PDL1-IFN-R01-B03 | 2,383 | 4,072 | 44,076 |
| PDL1-IFN-R01-B04 | 2,518 | 12,736 | 42,948 |
| PDL1-IFN-R01-B04V2 | 2,703 | 12,952 | 43,748 |
| PDL1-IFN-R01-B05 | 2,074 | 3,480 | 50,563 |
| PDL1-IFN-R01-B06 | 3,084 | 17,212 | 43,958 |
| PDL1-IFN-R01-B07 | 2,897 | 6,271 | 40,647 |
| PDL1-IFN-R01-B07V2 | 2,907 | 6,111 | 42,880 |
| PDL1-IFN-R01-B08 | 2,924 | 4,042 | 46,089 |
| PDL1-IFN-R01-B09 (SEQ ID NO: 24) | 1,378 | 35,717 | 31,232 |
| PDL1-IFN-R01-B10 | 899 | 4,118 | 46,508 |
| PDL1-IFN-R01-B11 | 2,525 | 14,580 | 43,204 |
| PDL1-IFN-R01-B12 (SEQ ID NO: 25) | 2,977 | 9,230 | 44,505 |
| PDL1-IFN-R01-C01 | 2,780 | 6,975 | 47,032 |
| PDL1-IFN-R01-C02 | 2,923 | 4,123 | 49,398 |
| PDL1-IFN-R01-C03 | 2,671 | 6,522 | 46,323 |
| PDL1-IFN-R01-C04 | 2,917 | 7,761 | 48,699 |
| PDL1-IFN-R01-C05 | 2,802 | 3,427 | 47,470 |
| PDL1-IFN-R01-C06 | 399 | 4,380 | 49,878 |
| PDL1-IFN-R01-C06V2 | 391 | 4,130 | 47,685 |

TABLE 4-continued

Fluorescence Signal Values from Binding and Inhibition Curves

| Name | PDL1 Binding | IFNα Binding | IFNAR2-IFN binding |
|---|---|---|---|
| PDL1-IFN-R01-C07 | 2,139 | 24,494 | 43,262 |
| PDL1-IFN-R01-C08 (SEQ ID NO: 26) | 2,746 | 45,175 | 14,739 |
| PDL1-IFN-R01-C08V2 | 2,812 | 55,319 | 16,753 |
| PDL1-IFN-R01-C09 | 2,388 | 4,346 | 48,696 |
| PDL1-IFN-R01-C10 | 2,489 | 12,727 | 43,275 |
| PDL1-IFN-R01-C10V2 | 2,665 | 11,972 | 43,576 |
| PDL1-IFN-R01-C11 (SEQ ID NO: 27) | 3,043 | 7,730 | 40,503 |
| PDL1-IFN-R01-C12 | 1,006 | 13,135 | 44,871 |
| PDL1-IFN-R01-D01 | 582 | 7,018 | 39,109 |
| PDL1-IFN-R01-D03 | 2,904 | 6,084 | 42,638 |
| PDL1-IFN-R01-D05 | 2,325 | 6,402 | 49,246 |
| PDL1-IFN-R01-D06 | 2,907 | 8,326 | 45,581 |
| PDL1-IFN-R01-D07 | 414 | 4,974 | 38,164 |
| anti-Her2 control (SEQ ID NO: 28) | 425 | 4,275 | 52,922 |
| Anti-PD-L1 control (SEQ ID NO: 29) | 2,445 | 1,803 | 39,121 |
| Anti-IFN control (SEQ ID NO: 30) | 416 | 19,098 | 51,190 |
| No DNA control | 422 | 4,135 | 45,042 |

Example 2

Isolation of a Set of Dual-Binding Antibodies (DBAs) that Bind Human PD-1 and Human IL-2

This example describes the isolation of sensor domains of the present disclosure, specifically, a set of DBAs that bind human PD-1 and human IL-2. Anti-PD-1 and anti-IL-2 DBAs were isolated from a Tumbler antibody phage display library (Distributed Bio, Inc.). The antibody phage display library was constructed to incorporate the heavy chain CDR1, heavy chain CDR2, and light chain diversity of the Superhuman 2.0 antibody library combined with 10 heavy chain CDR3 sequences from PD-1 binding antibodies (SEQ ID NO: 11-SEQ ID NO: 20).

TABLE 5

HC-CDR3 of PD-1 binders

| SEQ ID NO | Sequence | Description |
|---|---|---|
| SEQ ID NO: 11 | CAAGLFIW | HC-CDR3 of PD-1 binder |
| SEQ ID NO: 12 | CAGGWLDW | HC-CDR3 of PD-1 binder |
| SEQ ID NO: 13 | CARDHLGGSYQPW | HC-CDR3 of PD-1 binder |
| SEQ ID NO: 14 | CARDLVGVSPGINYVPRYYYYYYGMDVW | HC-CDR3 of PD-1 binder |
| SEQ ID NO: 15 | CARDTGLGYYYGSGDFDYW | HC-CDR3 of PD-1 binder |
| SEQ ID NO: 16 | CARSGYSYGYYFDYW | HC-CDR3 of PD-1 binder |
| SEQ ID NO: 17 | CARTGGYPAIDSW | HC-CDR3 of PD-1 binder |
| SEQ ID NO: 18 | CASGWDVW | HC-CDR3 of PD-1 binder |
| SEQ ID NO: 19 | CASSPLQWVDVW | HC-CDR3 of PD-1 binder |
| SEQ ID NO: 20 | CTSGMDVW | HC-CDR3 of PD-1 binder |

Figure 3:
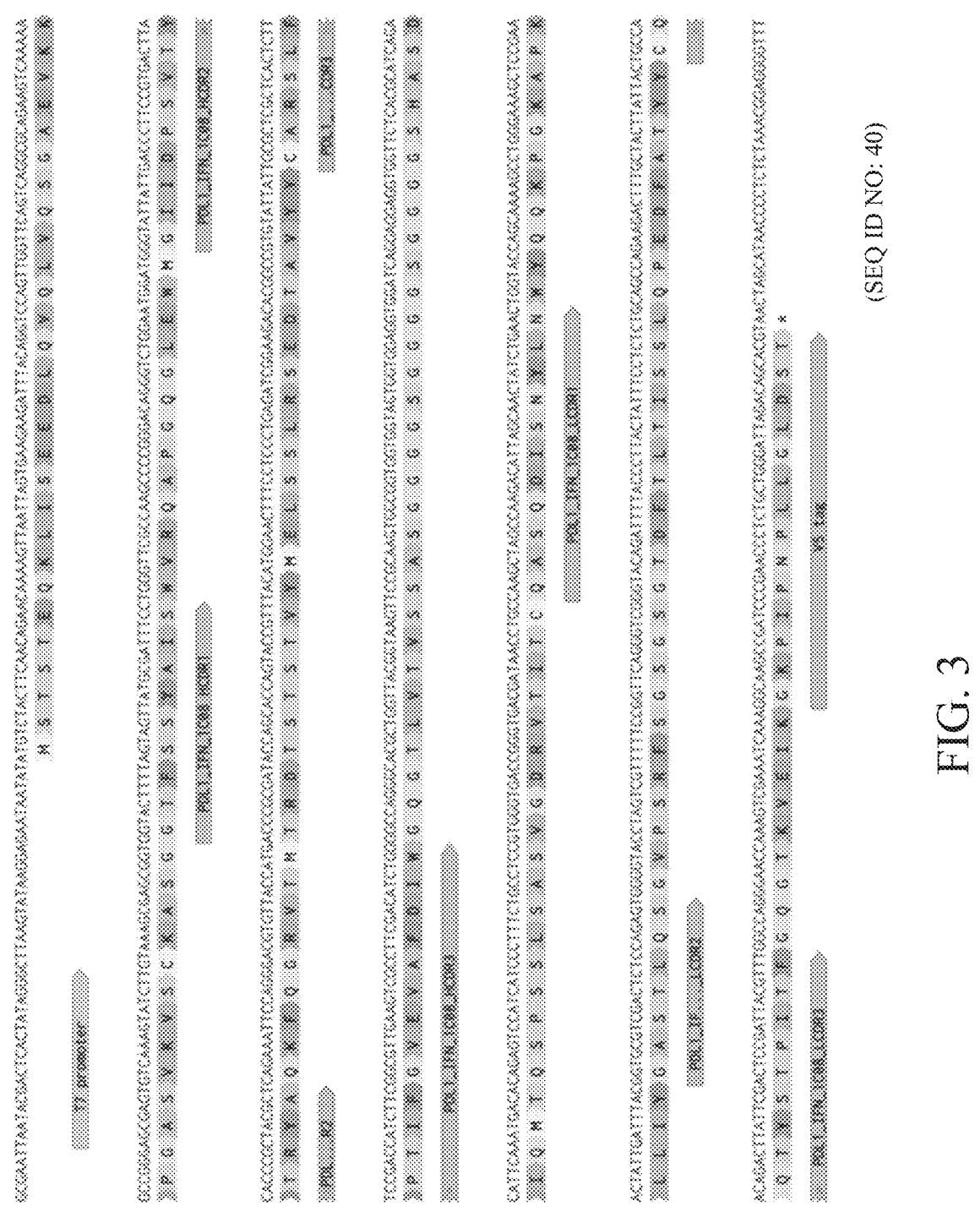

This library was subjected to four rounds of selection with standard protocols. In brief, the phage library was incubated with the antigen, then captured on magnetic beads and washed on a Kingfisher magnetic particle processor, eluted form the magnetic beads and amplified by passaging in *E. coli*. Round 1 was incubated with 50 nM human PD-1-His fusion (R&D Systems, Prod. Num. 8986-PD) and captured with TRIS NTA Biotin (Sigma-Aldrich Prod. Num. 75543) and streptavidin magnetic beads. Round 2 was incubated with 100 nM biotinylated IL-2 (Creative Biomart, Prod. Num. IL2-501H, biotinylated using standard protocols) and captured on streptavidin magnetic beads. Round 3 was incubated with 50 nM cynomolgus PD-1-Fc fusion (R&D Systems, Prod. Num. 8578-PD) and captured on protein G magnetic beads. Round 4 was incubated with 50 nM biotinylated human IL-2 and captured on streptavidin magnetic beads. The final selection was plated as single colonies and 380 colonies picked for Sanger sequencing. One hundred and fifty-one unique clones were chosen for expression. The scFv sequence for each clone was codon-optimized for *E. coli* expression and the corresponding DNA sequences sent to Integrated DNA Technologies, Inc. (IDT) for synthesis as gBlocks with a T7 promoter, a translation initiation site and a T7 terminator (see an exemplary gBlock sequence in FIG. 3). Protein from each gBlock encoding an scFv was expressed using the PURExpress In vitro Protein Synthesis Kit (New England Biolabs, Inc., Prod. Num. E6800). The PURExpress scFv proteins were used directly in HTRF binding assays and cell-based functional assays. Each scFv was tested for binding to PD-1 and to human IL-2. Eighty-one of the antibodies showed dual-binding activity for both PD-1 and IL-2 and a summary of fluorescence signal values of binding curves is shown in TABLE 7. To examine the ability of DBA binding domains to block IL-2 receptor binding, V5-tagged DBA scFvs were serially diluted in a 384 well plate. Europium-labeled Streptavidin, biotin-labeled IL-2 (Acro Biosystems, Prod. Num. IL2-H82E4), IL-2 Receptor beta (Fc-IL2RB) (Acro Biosystems, Prod. Num. ILB-H5253), and APC-labeled anti-Fc antibody. Plates were incubated at room temperature for 2 hours, and the HTRF signal was read on an Envision (Perkin Elmer) as a measure of IL-2:IL2RB binding. Four scFvs (SEQ TD NO: 31-SEQ TD NO: 34) bound PD-1, bound IL-2 and blocked binding of IL-2 to IL-2RB (TABLE 7).

TABLE 6

DBAs and Controls

| SEQ ID NO | Sequence | Description |
| --- | --- | --- |
| SEQ ID NO: 31 | QVQLVQSGAEVKKPGVSVKVSCKASGYTF PRSYIHWVRQAPGQGLEWMGWINPHSGDT YYAQNFQGRVTMTRDTSTSTVYMELSSLR SEDTAVYYCARDTGLGYYYGSGDFDYWG QGTLVTVSSASGGGGSGGGGSGGGGSHAS DIQMTQSPSSLSASVGDRVTITCRASQSISR YLNWYQQKPGKAPKLLIYTASSLQSGVPSR FSGSGSGTDFTLTISSLQPEDFATYYCQQAN RFPLTFGPGTKVDIK | DBA capable of binding a PD-1 marker and IL-2 therapeutic |
| SEQ ID NO: 32 | QVQLVQSGAEVKKPGASVKVSCKASGYTF PRYHIHWVRQAPGQGLEWMGMINPSGGTT TYAQKFQGRVTMTRDTSTSTVYMELSSLR SEDTAVYYCARDTGLGYYYGSGDFDYWG QGTLVTVSSASGGGGSGGGGSGGGGSHAS DIQMTQSPSSLSASVGDRVTITCRASQSISS WLAWYQQKPGKAPKLLIYAASSLQSGVPS RFSGSGSGTDFTLTISSLQPEDFATYYCQQS HSFPLTFGGGTKVEIK | DBA capable of binding a PD-1 marker and IL-2 therapeutic |
| SEQ ID NO: 33 | QVQLVQSGAEVKKPGASVKVSCKASGYTF TRYYIHWVRQAPGQGLEWMGWINAYNGD TNYAQKLQGRVTMTRDTSTSTVYMELSSL RSEDTAVYYCARDSYYYDSFDYWGQGTL VTVSSASGGGGSGGGGSGGGGSHASDIQM TQSPSSLSASVGDRVTITCRASQTITDWLA WYQQKPGKAPKLLIYGASNLQGGVPSRFS GSGSGTDFTLTISSLQPEDFATYYCQQYYSS WTFGQGTKVEIK | DBA capable of binding a PD-1 marker and IL-2 therapeutic |
| SEQ ID NO: 34 | QVQLVQSGAEVKKPGASVKVSCKASGYTF TSYYMHWVRQAPGQGLEWMGIINPSDGST TYAQSFQGRVTMTRDTSTSTVYMELSSLRS EDTAVYYCASGWDVWGQGTLVTVSSASG GGGSGGGGSGGGGSHASDIVMTQSPDSLA VSLGERATINCKSSQSVFSSANNKNYLAW YQQKPGQPPKLLIYWASTRESGVPDRF SGS GSGTDFTLTISSLQAEDVAVYYCQQYFGTP VTFGGGTKVEIK | DBA capable of binding a PD-1 marker and IL-2 therapeutic |

TABLE 7

| Name | PD1 Binding | IL2 Binding | IL2RB Blocking |
| --- | --- | --- | --- |
| No DNA | 5 | 6 | 1,490 |
| PD1-IL2-R01-H08 | 576 | −9 | 1,829 |
| PD1-IL2-R01-H09 | 1,015 | 131 | 1,772 |
| PD1-IL2-R02-A03 | 1,508 | 635 | 1,714 |
| PD1-IL2-R02-A04 | 909 | 978 | 1,618 |
| PD1-IL2-R02-A05 | 1,557 | 23 | 1,735 |
| PD1-IL2-R02-A06 | 357 | 515 | 1,772 |
| PD1-IL2-R02-A08 | 995 | 520 | 1,612 |
| PD1-IL2-R02-A09 | 1,421 | 1,470 | 1,495 |
| PD1-IL2-R02-A10 | 500 | 838 | 1,847 |
| PD1-IL2-R02-A11 | 1,625 | 1,559 | 1,783 |
| PD1-IL2-R02-A12 | 1,725 | 130 | 1,586 |
| PD1-IL2-R02-B01 | 746 | 1,077 | 1,516 |
| PD1-IL2-R02-B02 | 1,740 | 1,107 | 1,849 |
| PD1-IL2-R02-B04 | 11 | 2,346 | 1,536 |
| PD1-IL2-R02-B05 | 1,665 | 2,489 | 1,613 |
| PD1-IL2-R02-B06 | 1,527 | 32 | 1,605 |
| PD1-IL2-R02-B07 | 1,685 | 628 | 1,814 |
| PD1-IL2-R02-B08 | 1,446 | 92 | 1,680 |
| PD1-IL2-R02-B10 | 211 | 343 | 1,607 |
| PD1-IL2-R02-B11 | 1,426 | 915 | 1,509 |
| PD1-IL2-R02-B12 | 1,264 | 316 | 1,762 |
| PD1-IL2-R02-C01 | 1,463 | 296 | 1,743 |
| PD1-IL2-R02-C02 (SEQ ID NO: 31) | 1,299 | 298 | 1,069 |
| PD1-IL2-R02-C03 (SEQ ID NO: 32) | 1,383 | 293 | 1,211 |
| PD1-IL2-R02-C04 | 1,622 | 575 | 1,857 |
| PD1-IL2-R02-C06 | 1,376 | 34 | 1,684 |
| PD1-IL2-R02-C07 | 34 | 87 | 1,607 |
| PD1-IL2-R02-C08 | 1,468 | 619 | 1,671 |
| PD1-IL2-R02-C10 | 174 | 256 | 1,757 |
| PD1-IL2-R02-C12 | 1,367 | 340 | 1,723 |
| PD1-IL2-R02-D01 | 1,421 | 68 | 1,614 |
| PD1-IL2-R02-D02 | 1,473 | 539 | 1,726 |
| PD1-IL2-R06-A10 | 1,269 | 9 | 1,796 |
| PD1-IL2-R06-A11 | 1,376 | 34 | 1,762 |
| PD1-IL2-R06-A12 | 1,305 | 7 | 1,681 |
| PD1-IL2-R06-B01 | 10 | 2,109 | 1,307 |
| PD1-IL2-R06-B02 | 1,666 | 15 | 1,799 |
| PD1-IL2-R06-B03 | 923 | 4 | 1,661 |
| PD1-IL2-R06-B04 | 1,782 | 28 | 1,666 |
| PD1-IL2-R06-B06 | 1,223 | 17 | 1,648 |
| PD1-IL2-R06-B08 | 1,777 | 1,160 | 1,738 |
| PD1-IL2-R06-B10 | 13 | 31 | 1,847 |
| PD1-IL2-R06-B11 | 1,534 | 24 | 1,699 |
| PD1-IL2-R06-B12 | 822 | 1,125 | 1,604 |
| PD1-IL2-R06-C02 | 1,667 | 26 | 1,671 |
| PD1-IL2-R06-C04 | 1,491 | 7 | 1,759 |
| PD1-IL2-R06-C08 | 1,448 | 8 | 1,693 |
| PD1-IL2-R06-C09 | 1,158 | 1,525 | 1,602 |
| PD1-IL2-R06-C11 | 1,879 | −2 | 1,785 |
| PD1-IL2-R06-C12 | 1,669 | 1,998 | 1,033 |
| PD1-IL2-R06-D02 | 280 | 432 | 1,677 |
| PD1-IL2-R06-D03 | 9 | 93 | 1,606 |
| PD1-IL2-R06-D05 | 505 | −3 | 1,786 |
| PD1-IL2-R06-D07 | 1,577 | 24 | 1,820 |
| PD1-IL2-R06-D10 | 1,751 | 49 | 1,719 |

TABLE 7-continued

| Name | PD1 Binding | IL2 Binding | IL2RB Blocking |
|---|---|---|---|
| PD1-IL2-R06-D11 | 405 | 593 | 1,576 |
| PD1-IL2-R06-D12 | 1,024 | 1,423 | 1,649 |
| PD1-IL2-R06-E01 | 1,628 | 3 | 1,724 |
| PD1-IL2-R06-E02 | 1,554 | 16 | 1,598 |
| PD1-IL2-R06-E04 (SEQ ID NO: 33) | 50 | 247 | 1,108 |
| PD1-IL2-R06-E05 | 1,364 | 14 | 1,734 |
| PD1-IL2-R06-E06 | 1,627 | 15 | 1,735 |
| PD1-IL2-R06-E07 | 1,801 | 12 | 1,698 |
| PD1-IL2-R06-E09 | 1,467 | 11 | 1,511 |
| PD1-IL2-R06-E11 | 1,805 | 294 | 1,767 |
| PD1-IL2-R06-E12 | 4 | −7 | 1,735 |
| PD1-IL2-R06-F01 | 196 | 280 | 1,629 |
| PD1-IL2-R06-F03 | 1,377 | 28 | 1,642 |
| PD1-IL2-R06-F04 | 26 | 779 | 1,726 |
| PD1-IL2-R06-F05 | 1,493 | 18 | 1,625 |
| PD1-IL2-R06-F06 | 1,577 | 46 | 1,595 |
| PD1-IL2-R06-F07 | 1,544 | 335 | 1,682 |
| PD1-IL2-R06-F08 | 1,570 | 9 | 1,780 |
| PD1-IL2-R06-F09 | 30 | 41 | 1,776 |
| PD1-IL2-R06-F10 | 1,745 | 24 | 1,607 |
| PD1-IL2-R06-F11 | 1,586 | 12 | 1,574 |
| PD1-IL2-R06-F12 | 623 | 8 | 1,645 |
| PD1-IL2-R06-G01 | 130 | 184 | 1,640 |
| PD1-IL2-R06-G02 | 1,754 | 20 | 1,623 |
| PD1-IL2-R06-G04 | 1,348 | 13 | 1,596 |
| PD1-IL2-R06-G05 | 1,382 | 10 | 1,846 |
| PD1-IL2-R06-G06 | 1,383 | 4 | 1,744 |
| PD1-IL2-R06-G08 | 1,708 | 124 | 1,533 |
| PD1-IL2-R06-G09 | 557 | 756 | 1,527 |
| PD1-IL2-R06-G10 | 1,595 | 35 | 1,703 |
| PD1-IL2-R06-G11 | 1,469 | 17 | 1,709 |
| PD1-IL2-R06-G12 | 1,281 | 1,479 | 1,713 |
| PD1-IL2-R06-H01 | 381 | 4 | 1,647 |
| PD1-IL2-R06-H02 | 1,501 | 20 | 1,748 |
| PD1-IL2-R06-H03 | 1,132 | 1,449 | 1,617 |
| PD1-IL2-R06-H04 | 355 | 1 | 1,677 |
| PD1-IL2-R06-H05 | 1,409 | 21 | 1,561 |
| PD1-IL2-R06-H06 | 1,491 | 23 | 1,650 |
| PD1-IL2-R06-H07 | 12 | 13 | 1,701 |
| PD1-IL2-R06-H08 | 847 | 1,118 | 1,746 |
| PD1-IL2-R06-H09 | 1,732 | 22 | 1,662 |
| PD1-IL2-R06-H10 | 830 | 1,151 | 1,569 |
| PD1-IL2-R07-A03 | 1,786 | 28 | 1,511 |
| PD1-IL2-R07-A04 | 730 | 973 | 1,613 |
| PD1-IL2-R07-A05 | 477 | 663 | 1,327 |
| PD1-IL2-R07-A08 | 1,628 | 841 | 1,618 |
| PD1-IL2-R07-A09 (SEQ ID NO: 34) | 1,235 | 2,040 | 910 |
| PD1-IL2-R07-A10 | 1,716 | 63 | 1,518 |
| PD1-IL2-R07-B01 | 1,397 | 32 | 1,565 |
| PD1-IL2-R07-B02 | 192 | 321 | 1,634 |
| PD1-IL2-R07-B03 | 65 | 202 | 1,604 |
| PD1-IL2-R07-B04 | 1,862 | 410 | 1,527 |
| PD1-IL2-R07-B05 | 965 | 351 | 1,389 |
| PD1-IL2-R07-B06 | 1,882 | 44 | 1,497 |
| PD1-IL2-R07-B07 | 6 | 2,549 | 1,517 |
| PD1-IL2-R07-B08 | 906 | 1,047 | 1,475 |
| PD1-IL2-R07-B09 | 1,788 | 27 | 1,384 |
| PD1-IL2-R07-B10 | 18 | 19 | 1,635 |
| PD1-IL2-R07-B11 | 1,765 | 9 | 1,641 |
| PD1-IL2-R07-C01 | 230 | 367 | 1,536 |
| PD1-IL2-R07-C02 | 236 | 304 | 1,500 |
| PD1-IL2-R07-C03 | 20 | 1,347 | 1,536 |
| PD1-IL2-R07-C07 | 15 | 275 | 1,665 |
| PD1-IL2-R07-C10 | 1,064 | 317 | 1,550 |
| PD1-IL2-R07-C11 | 1,523 | 642 | 1,460 |
| PD1-IL2-R07-C12 | 1,377 | 49 | 1,707 |
| PD1-IL2-R07-D01 | 1,541 | 79 | 1,657 |
| PD1-IL2-R07-D03 | 1,483 | 33 | 1,481 |
| PD1-IL2-R07-D04 | 923 | 1,104 | 1,517 |
| PD1-IL2-R07-D06 | 1,664 | 416 | 1,734 |
| PD1-IL2-R07-D07 | 6 | 835 | 1,512 |
| PD1-IL2-R07-D10 | 1,580 | 193 | 1,572 |
| PD1-IL2-R07-D11 | 1,401 | 798 | 1,614 |
| PD1-IL2-R07-E02 | 1,473 | 992 | 1,830 |
| PD1-IL2-R07-E03 | 1,459 | 422 | 1,683 |
| PD1-IL2-R07-E05 | 512 | 913 | 1,513 |
| PD1-IL2-R07-E06 | 1,483 | 1,178 | 1,526 |
| PD1-IL2-R07-E07 | 1,181 | 1,060 | 1,524 |
| PD1-IL2-R07-E08 | 1,604 | 472 | 1,717 |
| PD1-IL2-R07-E09 | 1,733 | 23 | 1,569 |
| PD1-IL2-R07-E10 | 1,472 | 251 | 1,545 |
| PD1-IL2-R07-E11 | 1,146 | 56 | 1,777 |
| PD1-IL2-R07-E12 | 1,698 | 106 | 1,764 |
| PD1-IL2-R07-F01 | 3 | 17 | 1,529 |
| PD1-IL2-R07-F02 | 348 | 752 | 1,537 |
| PD1-IL2-R07-F03 | 1,788 | 520 | 1,750 |
| PD1-IL2-R07-F04 | 1,416 | 145 | 1,767 |
| PD1-IL2-R07-F06 | 1,422 | 438 | 1,579 |
| PD1-IL2-R07-F09 | 1,589 | 17 | 1,456 |
| PD1-IL2-R07-F10 | 24 | 19 | 1,778 |
| PD1-IL2-R07-F12 | 505 | 196 | 1,553 |
| PD1-IL2-R07-G01 | 4 | 214 | 1,560 |
| PD1-IL2-R07-G02 | 1,610 | 61 | 1,735 |
| PD1-IL2-R07-G04 | 82 | 147 | 1,600 |
| PD1-IL2-R07-G05 | 981 | 216 | 1,475 |
| PD1-IL2-R07-G06 | 860 | 512 | 1,655 |
| PD1-R04-C10 | 1,552 | 4 | 1,550 |
| PD1-R07-A05 | 653 | 19 | 1,730 |
| PD1-R07-A10 | 484 | 25 | 2,290 |
| PD1-R07-C09 | 1,911 | 20 | 2,080 |
| PD1-R07-D03 | 1,733 | 22 | 2,208 |
| PD1-R07-D05 | 1,760 | 16 | 1,578 |
| PD1-R07-D06 | 1,997 | 22 | 1,749 |
| PD1-R07-E05 | 633 | 24 | 2,246 |
| PD1-R07-G12 | 907 | 11 | 1,577 |
| PD1-R15-B02 | 1,671 | 28 | 1,797 |
| PDL1-DB03-H02 | 18 | 11 | 1,725 |
| Anti-Her2 (SEQ ID NO: 28) | 4 | 20 | 1,636 |

Example 3

Competitive Binding for Targets of Dual Binding Antibodies (DBAs)

Figure 7:
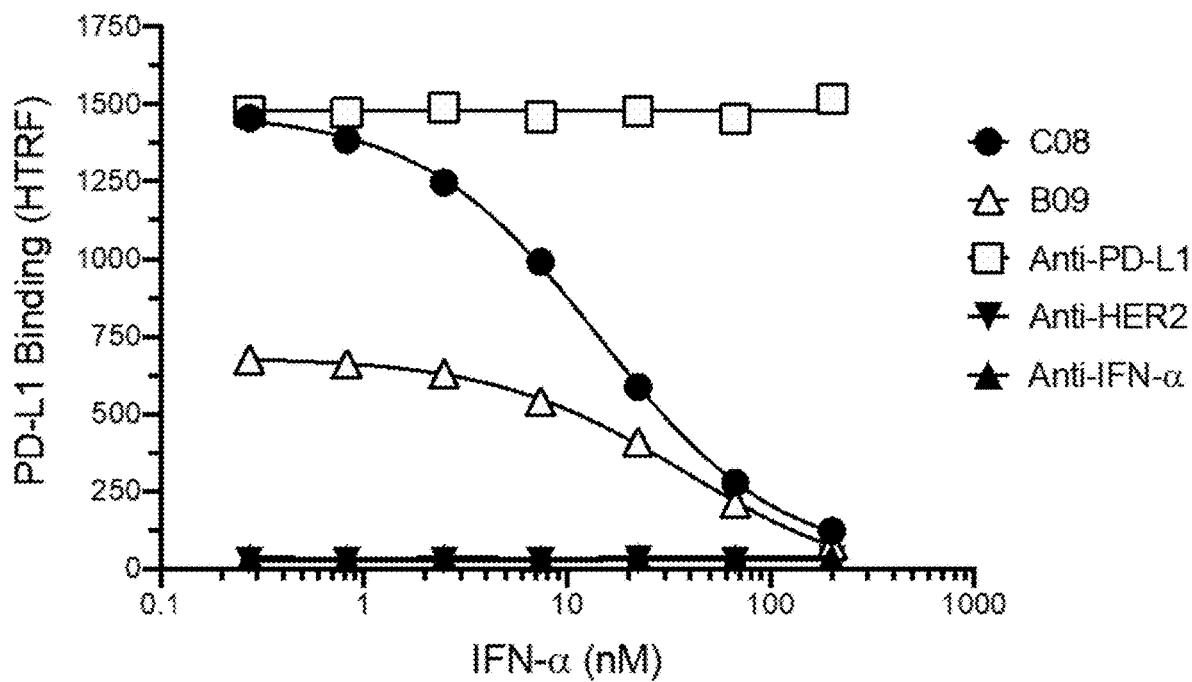
FIG. 7 shows IFNα can compete with PD-L1 for binding to candidate PD-L1/IFNα DBAs of SEQ ID NO: 24 and SEQ ID NO: 26.

This example describes competitive binding between the marker and the therapeutic domain of dual binding antibodies (DBAs). To test the ability of PD-L1 (marker) to compete with IFNα (therapeutic) for binding to the DBA binding domains, V5-tagged DBA or control scFvs were synthesized using the PUREfrex 2.1 in vitro translation system and added to a 384 well plate at a single dilution. Eu-labeled PD-L1 and Alexa Fluor 647-labeled anti-V5 antibody were added to all wells and incubated for 30 minutes at room temperature. Titrated concentrations of IFNα were added to all wells and the plate was incubated for 1 hour at room temperature. The HTRF signal was read on Envision (Perkin Elmer). As shown in FIG. 7, IFNα competed with PD-L1 for binding to DBA clones B09 (SEQ ID NO: 24) and C08 (SEQ ID NO: 26), whereas the binding of an anti-PD-L1 monospecific antibody was unaffected by the concentration of IFNα.

Example 4

Screening Dual Binding Antibodies (DBAs) for Improved Binding Affinity

This example illustrates screening dual binding antibodies (DBAs) for improved binding affinity. The sequences for each DBA were aligned with the parental, single specificity antibody from which it was derived and with other DBAs derived from the same parental, single specificity antibody. Using this sequence information, variants with amino acid substitutions in and adjacent to the CDR regions were designed to test for altered binding to either antigen. Additionally, consideration was given to sequence variants that may improve stability. Representative variants are shown in TABLE 8 and TABLE 9. CDR sequences provided in TABLE 8 and TABLE 9 correspond to HCDR1-HCDR2-HCDR3, with substitutions underlined and in bold. Sequences of dual binding PD-L1 and IFNα variants are provided in TABLE 10.

TABLE 8

Heavy chain CDR regions of anti-PDL1 02_A08, DBA PDL1-IFN_1A05, and variants

| SEQ ID NO | Description | CDR Sequence |
|---|---|---|
| SEQ ID NO: 305 | Parental monospecific antibody PDL1_02_A08 | CKASGYTFSGYYMHW-WMGWMDPNSGYTGYAHQFQGRV-CAKEVFSGWYDYWGQ |
| SEQ ID NO: 306 | Dual-binding antibody (DBA) PDL1-IFN R01_A05 | CKASGYTFSNYYIHW-WMGWMDSNSGGTGYAQKFQGRV-CAKEVFSGWYDYWGQ |
| SEQ ID NO: 307 | DBA variant H_N36G | CKASGYTFSGYYIHW-WMGWMDSNSGGTGYAQKFQGRV-CAKEVFSGWYDYWGQ |
| SEQ ID NO: 308 | DBA variant H_I39V_S58P_Q69H_K70Q | CKASGYTFSNYYVHW-WMGWMDPNSGGTGYAHQFQGRV-CAKEVFSGWYDYWGQ |
| SEQ ID NO: 309 | DBA variant H_G64Y_Q69H | CKASGYTFSNYYIHW-WMGWMDSNSGYTGYAHKFQGRV-CAKEVFSGWYDYWGQ |

TABLE 9

Light chain CDR regions of anti-PDL1 02_A08, DBA PDL1-IFN_1A05, and variants

| SEQ ID NO | Construct | CDR Sequence |
|---|---|---|
| SEQ ID NO: 310 | Parental monospecific antibody PDL1_02_A08 | CRASQTISSYLNWY-IYAASTLESGVPSR-YYCQQGYSTPITFGPGTKVDIK |
| SEQ ID NO: 311 | Dual-binding antibody (DBA) PDL1-IFN_R01_A05 | CRASQSISSYLNWY-IYAASSLQSGVPSR-YYCQQSYSTPYTFGQGTKVEIK |
| SEQ ID NO: 312 | L_Q68E | CRASQSISSYLNWY-IYAASSLESGVPSR-YYCQQSYSTPYTFGQGTKVEIK |
| SEQ ID NO: 313 | L_Q68E_E125D | CRASQSISSYLNWY-IYAASSLESGVPSR-YYCQQSYSTPYTFGQGTKVDIK |

TABLE 10

Sequences of dual binding PD-L1 and IFNα variants

| SEQ ID NO | Variant | Sequence |
|---|---|---|
| SEQ ID NO: 35 | H_N36G | QVQLVQSGAEVKKPGASVKVSCKASGYTFSGYYIHWVRQAPGQGLEWMGWMDSNSGGTGYAQKFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK |
| SEQ ID NO: 36 | H_I39V_S58P_Q69H_K70Q | QVQLVQSGAEVKKPGASVKVSCKASGYTFSNYYVHWVRQAPGQGLEWMGWMDPNSGGTGYAHQFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK |

TABLE 10-continued

Sequences of dual binding PD-L1 and IFNα variants

| SEQ ID NO | Variant | Sequence |
|---|---|---|
| SEQ ID NO: 37 | H_G64Y_Q69H | QVQLVQSGAEVKKPGASVKVSCKASGYTFSNYYIHW VRQAPGQGLEWMGWMDSNSGYTGYAHKFQGRVTMT RDTSTSTVYMELSSLRSEDTAVYYCAKEVFSGWYDY WGQGTLVTVSSASGGGGSGGGGSGGGGSHASDIQMT QSPSSLSASVGDRVTITCRASQSISSYLNWYQQKPGKA PKLLIYAASSLQSGVPSRFSGSGSGTDFTLTISSLQPEDF ATYYCQQSYSTPYTFGQGTKVEIK |
| SEQ ID NO: 38 | LQ68E | QVQLVQSGAEVKKPGASVKVSCKASGYTFSNYYIHW VRQAPGQGLEWMGWMDSNSGGTGYAQKFQGRVTMT RDTSTSTVYMELSSLRSEDTAVYYCAKEVFSGWYDY WGQGTLVTVSSASGGGGSGGGGSGGGGSHASDIQMT QSPSSLSASVGDRVTITCRASQSISSYLNWYQQKPGKA PKLLIYAASSLESGVPSRFSGSGSGTDFTLTISSLQPEDF ATYYCQQSYSTPYTFGQGTKVEIK |
| SEQ ID NO: 39 | LQ68E_E125D | QVQLVQSGAEVKKPGASVKVSCKASGYTFSNYYIHW VRQAPGQGLEWMGWMDSNSGGTGYAQKFQGRVTMT RDTSTSTVYMELSSLRSEDTAVYYCAKEVFSGWYDY WGQGTLVTVSSASGGGGSGGGGSGGGGSHASDIQMT QSPSSLSASVGDRVTITCRASQSISSYLNWYQQKPGKA PKLLIYAASSLESGVPSRFSGSGSGTDFTLTISSLQPEDF ATYYCQQSYSTPYTFGQGTKVDIK |

The scFv sequence for each variant was codon-optimized for *E. coli* expression and the corresponding DNA sequences synthesized as gBlocks (Integrated DNA Technologies, Inc.) with a T7 promoter, a translation initiation site, a Myc tag, the scFv sequence, a V5 tag sequence and a T7 terminator. Proteins encoded by the gBlock fragments were expressed using a cell-free transcription/translation system (Cosmo Bio USA, Inc., PUREfrex2.1, Product #GFK-PF213 with DS Supplement, Prod. #GFK-PF005). The cell-free expression samples were assayed for PD-L1 and IFNα binding as described in EXAMPLE 1.

Variants with different binding affinities may also be generated by display methods, such as phage display and mRNA display. Libraries for use in these methods may be created from the parental antibody by varying CDRs with random amino acid changes or by varying positions in the CDRs identified as suitable for change.

Example 5

Binding Affinity of Dual Binding Antibodies (DBAs)

This example describes binding affinity of protein complexes, specifically, dual binding antibodies (DBAs). Variants were synthesized as V5-tagged scFvs using the PUREfrex 2.1 in vitro translation system and diluted 1:30 in 1× kinetics buffer (KB, forteBIO) for testing. Biotinylated anti-V5 antibody (clone SV5-Pk1 BioRad, biotinylated using EZ-Link® Sulfo-NHS-LC-Biotin, THERMO) was diluted to 80 nM in 1× KB, then loaded onto streptavidin biosensor tips (SA, forteBIO) on an OctetRED96e instrument. These tips were then loaded with scFv for 240 seconds. The loaded tips were transferred to 1× KB for 60 seconds to establish baseline, then dipped into 160 nM ACRO human PDL1-his for 150 seconds to measure association, then into 1× KB for 180 seconds to measure dissociation. Immediately following this dissociation, baseline signal in 1× KB was measured, the tips were dipped into 5,000 nM IFNα2b (GenScript) for 150 seconds to measure association, then into 1× KB for 240 seconds to measure dissociation. Data were fit to a 1:1 kinetics model. Response for binding of IFNα2b was qualitative negative or positive. Sequences of the DBA variants used in TABLE 11 are provided in TABLE 8 and TABLE 9.

TABLE 11

| Kinetics of binding of DBA variants | | |
|---|---|---|
| | KD (PD-L1, nM) | IFNα binding (@5 uM) |
| H_G64Y_Q69H | 13 | +/− |
| H_I39V_S58P_Q69H_K70Q | 8 | − |
| H_N36G | 37 | + |
| L_Q68E | 21 | + |
| L_Q68E_E125D | 21 | + |
| PDL1-IFN_R01_A05 | 120 | Not tested |

The affinity of the DBA in this or other antibody formats may be measured in a similar manner to generate quantitative or semi-quantitative measurements using standard methods of measurement of protein interaction, including biolayer interferometry (e.g., Octet, Molecular Devices LLC.) surface plasmon resonance (e.g., BiaCore, GE Healthcare Life Sciences), kinetic exclusion (KinExA, Sapidyne Instruments, Inc.), or other biophysical methods. In addition, apparent affinity of a target for the DBA in the covalently linked construct may be measured with these methods by competition for a nonlinked binding agent.

Example 6

Dual Binding Antibody (DBA)-Cytokine Protein Complexes

This example describes dual binding antibody (DBA)-cytokine protein complexes of the present disclosure. Various DBA-cytokine protein complexes of the present disclosure were designed to include a cytokine, a linker, and one or more dual binding antibody domains. An exemplary protein complex is shown in FIG. 8 (at left) and its amino acid sequence is shown in FIG. 8 (at right). Pictorial representations of other exemplary constructs are shown in FIG. 9 (SEQ ID NO: 42-SEQ ID NO: 54 and SEQ ID NO: 77-SEQ ID NO: 79).

A series of DBA-cytokine protein complexes may be designed with two marker binding domains and one therapeutic domain. The DBAs used in this series, provided in TABLE 13 with sequences provided in TABLE 14, exhibit a range of affinities for the marker and the therapeutic domain. Exemplary DBA complexes are provided in TABLE 12, TABLE 15, and TABLE 16.

TABLE 12

Exemplary DBA Cytokine Protein Complexes

| SEQ ID NO | Sequences | Description |
|---|---|---|
| SEQ ID NO: 42 | QVQLVQSGAEVKKPGASVKVSCKASGYTFT KNYMHWVRQAPGQGLEWLGWVSPDSGYTG YAQKFQGRVTMTRDTSTSTVYMELSSLRSED TAVYYCTTDLLSLELDDAFDIWGQGTMVTVS SASGGGGSGGGGSGGGGSHASDIQMTQSPSS LSASVGDRVTITCRASQSISSWLAWYQQKPG KAPKLLIYAASTLQSGVPSRFSGSGSGTDFTLT ISSLQPEDFATYYCQQSYSTPLTFGGGTKLEIK PRGPTIKPCPPCKCPAPNAAGGPSVFIFPPKIK DVLMISLSPIVTCVVVDVSEDDPDVQISWFVN NVEVHTAQTQTHREDYNSTLRVVSALPIQHQ DWMSGKEFKCKVNNKDLGAPIERTISKPKGS VRAPQVYVLPPCEEEMTKKQVTLSCAVTDFM PEDIYVEWTNNGKTELNYKNTEPVLDSDGSY FMVSKLRVEKKNWVERNSYSCSVVHEGLHN HHTTKSFSRTPGK | PD-L1/IFNα protein complexes having a DBA sensor domain capable of binding a PD-L1 marker and IFNα therapeutic domain and having an IFNα therapeutic activity |
| SEQ ID NO: 43 | CDLPQTHSLGSRRTLMLLAQMRRISLFSCLKD RHDFGFPQEEFGNQFQKAETIPVLHEMIQQIF NLFSTKDSSAAWDETLLDKFCTELYQQLNDL EACVMQEERVGETPLMNADSILAVKKYFRRI TLYLTEKKYSPCAWEVVRAEIVRSLSLSTNLQ ERLRRKEGGGGSGGGGSGGGGSGGGGSQVQ LVQSGAEVKKPGASVKVSCKASGYTFSGYYI HWVRQAPGQGLEWMGWMDSNSGGTGYAQ KFQGRVTMTRDTSTSTVYMELSSLRSEDTAV YYCAKEVFSGWYDYWGQGTLVTVSSAKTTA PSVYPLAPVCGDTTGSSVTLGCLVKGYFPEPV TLTWNSGSLSSGVHTFPAVLQSDLYTLSSSVT VTSSTWPSQSITCNVAHPASSTKVDKKIEPRG PTIKPCPPCKCPAPNAAGGPSVFIFPPKIKDVL MISLSPIVTCVVVDVSEDDPDVQISWFVNNVE VHTAQTQTHREDYNSTLRVVSALPIQHQDW MSGKEFKCKVNNKDLGAPIERTISKPKGSVR APQVCVLPPPEEEMTKKQVTLWCMVTDFMP EDIYVEWTNNGKTELNYKNTEPVLDSDGSYF MYSKLRVEKKNWVERNSYSCSVVHEGLHNH HTTKSFSRTPGK | PD-L1/IFNα protein complexes having a DBA sensor domain capable of binding a PD-L1 marker and IFNα therapeutic domain and having an IFNα therapeutic activity |
| SEQ ID NO: 44 | DIQMTQSPSSLSASVGDRVTITCRASQSISSYL NWYQQKPGKAPKLLIYAASSLQSGVPSRFSG SGSGTDFTLTISSLQPEDFATYYCQQSYSTPYT FGQGTKVEIKRADAAPTVSIFPPSSEQLTSGGA SVVCFLNNFYPKDINVKWKIDGSERQNGVLN SWTDQDSKDSTYSMSSTLTLTKDEYERHNSY TCEATHKTSTSPIVKSFNRNEC | PD-L1/IFNα protein complexes having a DBA sensor domain capable of binding a PD-L1 marker and IFNα therapeutic domain and having an IFNα therapeutic activity |
| SEQ ID NO: 45 | QVQLVQSGAEVKKPGASVKVSCKASGGTFSS YAISWVRQAPGQGLEWMGIIDPSVTYTRYAQ KFQGRVTMTRDTSTSTVYMELSSLRSEDTAV YYCARSLFPTIFGVEVAFDIWGQGTLVTVSSA KTTAPSVYPLAPVCGDTTGSSVTLGCLVKGY FPEPVTLTWNSGSLSSGVHTFPAVLQSDLYTL SSSVTVTSSTWPSQSITCNVAHPASSTKVDKKI EPRGPTIKPCPPCKCPAPNAAGGPSVFIFPPKIK DVLMISLSPIVTCVVVDVSEDDPDVQISWFVN NVEVHTAQTQTHREDYNSTLRVVSALPIQHQ DWMSGKEFKCKVNNKDLGAPIERTISKPKGS VRAPQVYVLPPCEEEMTKKQVTLSCAVTDFM PEDIYVEWTNNGKTELNYKNTEPVLDSDGSY FMVSKLRVEKKNWVERNSYSCSVVHEGLHN HHTTKSFSRTPGK | PD-L1/IFNα protein complexes having a DBA sensor domain capable of binding a PD-L1 marker and IFNα therapeutic domain and having an IFNα therapeutic activity |

TABLE 12-continued

| Exemplary DBA Cytokine Protein Complexes | | |
|---|---|---|
| SEQ ID NO | Sequences | Description |
| SEQ ID NO: 46 | CDLPQTHSLGSRRTLMLLAQMRRISLFSCLKD RHDFGFPQEEFGNQFQKAETIPVLHEMIQQIF NLFSTKDSSAAWDETLLDKFCTELYQQLNDL EACVMQEERVGETPLMNADSILAVKKYFRRI TLYLTEKKYSPCAWEVVRAEIVRSLSLSTNLQ ERLRRKEGGGGSGGGGSGGGGSGGGGSQVQ LVQSGAEVKKPGASVKVSCKASGGTFSSYAIS WVRQAPGQGLEWMGIIDPSVTYTRYAQKFQ GRVTMTRDTSTSTVYMELSSLRSEDTAVYYC ARSLFPTIFGVEVAFDIWGQGTLVTVSSAKTT APSVYPLAPVCGDTTGSSVTLGCLVKGYFPEP VTLTWNSGSLSSGVHTFPAVLQSDLYTLSSSV TVTSSTWPSQSITCNVAHPASSTKVDKKIEPR GPTIKPCPPCKCPAPNAAGGPSVFIFPPKIKDV LMISLSPIVTCVVVDVSEDDPDVQISWFVNNV EVHTAQTQTHREDYNSTLRVVSALPIQHQDW MSGKEFKCKVNNKDLGAPIERTISKPKGSVR APQVCVLPPPEEEMTKKQVTLWCMVTDFMP EDIYVEWTNNGKTELNYKNTEPVLDSDGSYF MYSKLRVEKKNWVERNSYSCSVVHEGLHNH HTTKSFSRTPGK | PD-L1/IFNα protein complexes having a DBA sensor domain capable of binding a PD-L1 marker and IFNα therapeutic domain and having an IFNα therapeutic activity |
| SEQ ID NO: 47 | DIQMTQSPSSLSASVGDRVTITCQASQSISNYL AWYQQKPGKAPKLLIYKASSLESGVPSRFSGS GSGTDFTLTISSLQPEDFATYYCQQTYSTPITF GQGTKVEIKRADAAPTVSIFPPSSEQLTSGGAS VVCFLNNFYPKDINVKWKIDGSERQNGVLNS WTDQDSKDSTYSMSSTLTLTKDEYERHNSYT CEATHKTSTSPIVKSFNRNEC | PD-L1/IFNα protein complexes having a DBA sensor domain capable of binding a PD-L1 marker and IFNα therapeutic domain and having an IFNα therapeutic activity |
| SEQ ID NO: 48 | CDLPQTHSLGSRRTLMLLAQMRRISLFSCLKD RHDFGFPQEEFGNQFQKAETIPVLHEMIQQIF NLFSTKDSSAAWDETLLDKFCTELYQQLNDL EACVMQEERVGETPLMNADSILAVKKYFRRI TLYLTEKKYSPCAWEVVRAEIVRSLSLSTNLQ ERLRRKEGGGGSGGGGSGGGGSGGGGSQVQ LVQSGAEVKKPGASVKVSCKASGGTFSSYAIS WVRQAPGQGLEWMGIIDPSVTYTRYAQKFQ GRVTMTRDTSTSTVYMELSSLRSEDTAVYYC ARSLFPTIFGVEVAFDIWGQGTLVTVSSASGG GGSGGGGSGGGGSHASDIQMTQSPSSLSASV GDRVTITCQASQDISNYLNWYQQKPGKAPKL LIYGASTLQSGVPSRFSGSGSGTDFTLTISSLQP EDFATYYCQQTYSTPITFGQGTKVEIKAKTTA PSVYPLAPVCGDTTGSSVTLGCLVKGYFPEPV TLTWNSGSLSSGVHTFPAVLQSDLYTLSSSVT VTSSTWPSQSITCNVAHPASSTKVDKKIEPRG PTIKPCPPCKCPAPNAAGGPSVFIFPPKIKDVL MISLSPIVTCVVVDVSEDDPDVQISWFVNNVE VHTAQTQTHREDYNSTLRVVSALPIQHQDW MSGKEFKCKVNNKDLGAPIERTISKPKGSVR APQVYVLPPCEEEMTKKQVTLSCAVTDFMPE DIYVEWTNNGKTELNYKNTEPVLDSDGSYFM VSKLRVEKKNWVERNSYSCSVVHEGLHNHH TTKSFSRTPGK | ExemplarySeq_C_ Pep1 Asymmetric DBA-Cytokine Complex scFv-IgG format |
| SEQ ID NO: 49 | QVQLVQSGAEVKKPGASVKVSCKASGYTFSG YYIHWVRQAPGQGLEWMGWMDSNSGGTGY AQKFQGRVTMTRDTSTSTVYMELSSLRSEDT AVYYCAKEVFSGWYDYWGQGTLVTVSSAKT TAPSVYPLAPVCGDTTGSSVTLGCLVKGYFPE PVTLTWNSGSLSSGVHTFPAVLQSDLYTLSSS VTVTSSTWPSQSITCNVAHPASSTKVDKKIEP RGPTIKPCPPCKCPAPNAAGGPSVFIFPPKIKD VLMISLSPIVTCVVVDVSEDDPDVQISWFVNN VEVHTAQTQTHREDYNSTLRVVSALPIQHQD WMSGKEFKCKVNNKDLGAPIERTISKPKGSV RAPQVCVLPPPEEEMTKKQVTLWCMVTDFM PEDIYVEWTNNGKTELNYKNTEPVLDSDGSY FMYSKLRVEKKNWVERNSYSCSVVHEGLHN HHTTKSFSRTPGK | ExemplarySeq_C_ Pep2 Asymmetric DBA-Cytokine Complex scFv-IgG format |

TABLE 12-continued

Exemplary DBA Cytokine Protein Complexes

| SEQ ID NO | Sequences | Description |
| --- | --- | --- |
| SEQ ID NO: 50 | DIQMTQSPSSLSASVGDRVTITCRASQSISSYL<br>NWYQQKPGKAPKLLIYAASSLQSGVPSRFSG<br>SGSGTDFTLTISSLQPEDFATYYCQQSYSTPYT<br>FGQGTKVEIKRADAAPTVSIFPPSSEQLTSGGA<br>SVVCFLNNFYPKDINVKWKIDGSERQNGVLN<br>SWTDQDSKDSTYSMSSTLTLTKDEYERHNSY<br>TCEATHKTSTSPIVKSFNRNEC | ExemplarySeq_C_<br>Pep3<br>Asymmetric DBA-<br>Cytokine Complex<br>scFv-IgG format |
| SEQ ID NO: 51 | QVQLVQSGAEVKKPGASVKVSCKASGYTFST<br>YYIHWVRQAPGQGLEWMGIINPSGGGTVYA<br>QKFQGRVTMTRDTSTSTVYMELSSLRSEDTA<br>VYYCAAGLFIWGQGTLVTVSSAKTTAPSVYP<br>LAPVCGDTTGSSVTLGCLVKGYFPEPVTLTW<br>NSGSLSSGVHTFPAVLQSDLYTLSSSVTVTSST<br>WPSQSITCNVAHPASSTKVDKKIEPRGPTIKPC<br>PPCKCPAPNAAGGPSVFIFPPKIKDVLMISLSPI<br>VTCVVVDSEDDPDVQISWFVNNVEVHTAQ<br>TQTHREDYNSTLRVVSALPIQHQDWMSGKEF<br>KCKVNNKDLGAPIERTISKPKGSVRAPQVYV<br>LPPPEEEMTKKQVTLTCMVTDFMPEDIYVEW<br>TNNGKTELNYKNTEPVLDSDGSYFMYSKLRV<br>EKKNWVERNSYSCSVVHEGLHNHHTTKSFSR<br>TPGK | PD1-<br>IL2_6C12_N36T_<br>Sym_L_Long_Pep1<br>Symmetric DBA-<br>Cytokine Complex<br>IgG format |
| SEQ ID NO: 52 | APTSSSTKKTQLQLEHLLLDLQMILNGINNYK<br>NPKLTRMLTFKFYMPKKATELKHLQCLEEEL<br>KPLEEVLNLAQSKNFHLRPRDLISNINVIVLEL<br>KGSETTFMCEYADETATIVEFLNRWITFCQSII<br>STLTVPGVGVPGAGVPGVGVPGGGVPGVGV<br>PGGGVPGAGVPGGGVPGVGVPGAGVPGVGV<br>PGGGDIQMTQSPSSLSASVGDRVTITCRASQY<br>ISSGLAWYQQKPGKAPKLLIYKASSLDNGVPS<br>RFSGSGSGTDFTLTISSLQPEDFATYYCQQYE<br>RLPLTFGGGTKVEIKRADAAPTVSIFPPSSEQL<br>TSGGASVVCFLNNFYPKDINVKWKIDGSERQ<br>NGVLNSWTDQDSKDSTYSMSSTLTLTKDEYE<br>RHNSYTCEATHKTSTSPIVKSFNRNEC | PD1-<br>IL2_6C12_N36T_<br>Sym_L_Long_Pep2<br>Symmetric DBA-<br>Cytokine Complex<br>IgG format |
| SEQ ID NO: 53 | APTSSSTKKTQLQLEHLLLDLQMILNGINNYK<br>NPKLTRMLTFKFYMPKKATELKHLQCLEEEL<br>KPLEEVLNLAQSKNFHLRPRDLISNINVIVLEL<br>KGSETTFMCEYADETATIVEFLNRWITFCQSII<br>STLTGGGGSGGGGSGGGGSGGGGSQVQLVQ<br>SGAEVKKPGASVKVSCKASGYTFSTYYIHWV<br>RQAPGQGLEWMGIINPSGGGTVYAQKFQGR<br>VTMTRDTSTSTVYMELSSLRSEDTAVYYCAA<br>GLFIWGQGTLVTVSSAKTTAPSVYPLAPVCG<br>DTTGSSVTLGCLVKGYFPEPVTLTWNSGSLSS<br>GVHTFPAVLQSDLYTLSSSVTVTSSTWPSQSIT<br>CNVAHPASSTKVDKKIEPRGPTIKPCPPCKCP<br>APNAAGGPSVFIFPPKIKDVLMISLSPIVTCVV<br>VDVSEDDPDVQISWFVNNVEVHTAQTQTHRE<br>DYNSTLRVVSALPIQHQDWMSGKEFKCKVN<br>NKDLGAPIERTISKPKGSVRAPQVYVLPPPEEE<br>MTKKQVTLTCMVTDFMPEDIYVEWTNNGKT<br>ELNYKNTEPVLDSDGSYFMYSKLRVEKKNW<br>VERNSYSCSVVHEGLHNHHTTKSFSRTPGK | PD1-<br>IL2_6C12_N36T_<br>D68E_Sym_H_<br>ShortPep1<br>Symmetric DBA-<br>Cytokine Complex<br>IgG format |
| SEQ ID NO: 54 | DIQMTQSPSSLSASVGDRVTITCRASQYISSGL<br>AWYQQKPGKAPKLLIYKASSLENGVPSRFSG<br>SGSGTDFTLTISSLQPEDFATYYCQQYERLPLT<br>FGGGTKVEIKRADAAPTVSIFPPSSEQLTSGGA<br>SVVCFLNNFYPKDINVKWKIDGSERQNGVLN<br>SWTDQDSKDSTYSMSSTLTLTKDEYERHNSY<br>TCEATHKTSTSPIVKSFNRNEC | PD1-<br>IL2_6C12_N36T_<br>D68E_Sym_H_<br>Short_Pep2<br>Symmetric DBA-<br>Cytokine Complex<br>IgG format |
| SEQ ID NO: 77 | QVQLVQSGAEVKKPGASVKVSCKASGYTFTT<br>YYVHWVRQAPGQGLEWMGIINPSGGSTSYA<br>QNFQGRVTMTRDTSTSTVYMELSSLRSEDTA<br>VYYCASGWDVWGQGTTVTVSSAKTTAPSVY<br>PLAPVCGDTTGSSVTLGCLVKGYFPEPVTLT<br>WNSGSLSSGVHTFPAVLQSDLYTLSSSVTVTS<br>STWPSQSITCNVAHPASSTKVDKKIEPRGPTIK<br>PCPPCKCPAPNAAGGPSVFIFPPKIKDVLMISL<br>SPIVTCVVVDSEDDPDVQISWFVNNVEVHT<br>AQTQTHREDYNSTLRVVSALPIQHQDWMSG | PD1-<br>IL2_L_7A05scFv_<br>PD1-R07-<br>A05_Pep1<br>Asymmetric DBA-<br>Cytokine Complex<br>IgG-scFv format |

TABLE 12-continued

Exemplary DBA Cytokine Protein Complexes

| SEQ ID NO | Sequences | Description |
|---|---|---|
| | KEFKCKVNNKDLGAPIERTISKPKGSVRAPQV YVLPPPEEEMTKKQVTLTCMVTDFMPEDIYV EWTNNGKTELNYKNTEPVLDSDGSYFMYSD LRVEKKNWVERNSYSCSVVHEGLHNHHTTE SFSRTPGK | |
| SEQ ID NO: 78 | QVQLVQSGAEVKKPGASVKVSCKASGYTFTT YYVHWVRQAPGQGLEWMGIINPSGGSTSYA QNFQGRVTMTRDTSTSTVYMELSSLRSEDTA VYYCASGWDVWGQGTTVTVSSASGGGGSG GGGSGGGGSHASEIVMTQSPATESVSPGERAT LSCRASQSVNTYLAWYQQKPGQAPRLLIYGA STRATGIPARFSGSGSGTEFTLTISSLQSEDFAV YYCQQYGSSPVTFGQGTRLEIKPRGPTIKPCPP CKCPAPNAAGGPSVFIFPPKIKDVLMISLSPIV TCVVVDVSEDDPDVQISWFVNNVEVHTAQT QTHREDYNSTLRVVSALPIQHQDWMSGKEFK CKVNNKDLGAPIERTISKPKGSVRAPQVYVLP PPEKEMTKKQVSLTCLVKDFMPEDIYVEWTN NGKTELNYKNTEPVLKSDGSYFMYSKLTVEK KNWVERNSYSCSVVHEGLHNHHTTKSFSRTP GGGGSGGGSHHHHHH | PD1-IL2_L_7A05scFv_PD1-R07-A05_Pep2 Asymmetric DBA-Cytokine Complex IgG-scFv format |
| SEQ ID NO: 79 | APTSSSTKKTQLQLEHLLLDLQMILNGINNYK NPKLTDMLTFKFYMPKKATELKHLQCLEEEL KPLEEVLNLAQSKNFHLRPRDLISNINIVIVLEL KGSETTFMCEYADETATIVEFLNRWITFCQSII STLTGGGGSGGGGSGGGGSGGGGSEIVMTQS PATLSVSPGERATLSCRASQSVNTYLAWYQQ KPGQAPRLLIYGASTRATGIPARFSGSGSGTEF TLTISSLQSEDFAVYYCQQYGSSPVTFGQGTR LEIKRADAAPTVSIFPPSSEQLTSGGASVVCFL NNFYPKDINVKWKIDGSERQNGVLNSWTDQ DSKDSTYSMSSTLTLTKDEYERHNSYTCEAT HKTSTSPIVKSFNRNEC | PD1-IL2_L_7A05scFv_PD1-R07-A05_Pep3 Asymmetric DBA-Cytokine Complex IgG-scFv format |

TABLE 13

Dual-Binding Antibodies (DBAs)

| Dual-Binding Antibody | Marker | Therapeutic | HV* SEQ ID NO: | LV** SEQ ID NO: | HV_cdr1 SEQ ID NO: | HV_cdr2 SEQ ID NO: | HV_cdr3 SEQ ID NO: | LV_cdr1 SEQ ID NO: | LV_cdr2 SEQ ID NO: | LV_cdr3 SEQ ID NO: |
|---|---|---|---|---|---|---|---|---|---|---|
| AB001718 | PD-1 | IL-2 | 127 | 135 | 142 | 148 | 154 | 157 | 163 | 168 |
| AB001744 | PD-1 | IL-2 | 128 | 136 | 143 | 148 | 154 | 158 | 163 | 169 |
| AB002022 | PD-1 | IL-2 | 129 | 137 | 144 | 149 | 154 | 159 | 164 | 170 |
| AB001609 | PD-L1 | IFNα | 130 | 138 | 145 | 150 | 155 | 160 | 165 | 171 |
| AB001638 | PD-L1 | IFNα | 130 | 139 | 145 | 150 | 155 | 161 | 165 | 172 |
| AB001843 | PD-L1 | IFNα | 131 | 140 | 146 | 151 | 156 | 162 | 166 | 173 |
| AB001866 | PD-L1 | IFNα | 132 | 140 | 147 | 152 | 156 | 162 | 166 | 173 |
| AB001875 | PD-L1 | IFNα | 133 | 140 | 143 | 153 | 156 | 162 | 166 | 173 |
| AB001909 | PD-L1 | IFNα | 134 | 141 | 143 | 151 | 156 | 162 | 167 | 173 |

* HV refers to the heavy chain variable region of the respective antibodies
** LV refers to the light chain variable region of the respective antibodies

TABLE 14

Sequences of DBA Protein Components

| SEQ ID NO: | DBA Protein Component | Sequence |
|---|---|---|
| SEQ ID NO: 127 | AB001718_HV | QVQLVQSGAEVKKPGASVKVSCKASG DTFSTYYVHWVRQAPGQGLEWMGIINP SGGGTVYAQKFQGRVTMTRDTSTSTVY MELSSLRSEDTAVYYCAAGLFIWGQGT LVTVSS |

TABLE 14-continued

Sequences of DBA Protein Components

| SEQ ID NO: | DBA Protein Component | Sequence |
| --- | --- | --- |
| SEQ ID NO: 128 | AB001744_HV | QVQLVQSGAEVKKPGASVKVSCKASG YTFSNYYIHWVRQAPGQGLEWMGIINP SGGGTVYAQKFQGRVTMTRDTSTSTVY MELSSLRSEDTAVYYCAAGLFIWGQGT LVTVSS |
| SEQ ID NO: 129 | AB002022_HV | QVQLVQSGAEVKKPGASVKVSCKASG DTFTRHYVHWVRQAPGQGLEWMGIIN PSGGYASYAQKFQGRVTMTRDTSTSTV YMELSSLRSEDTAVYYCAAGLFIWGQG TLVTVSS |
| SEQ ID NO: 130 | AB001609_HV | QVQLVQSGAEVKKPGASVKVSCKASG GTFSSYAISWVRQAPGQGLEWMGIIDPS VTYTRYAQKFQGRVTMTRDTSTSTVY MELSSLRSEDTAVYYCARSLFPTIFGVE VAFDIWGQGTLVTVSS |
| SEQ ID NO: 131 | AB001843_HV | QVQLVQSGAEVKKPGASVKVSCKASG YTFSGYYIHWVRQAPGQGLEWMGWM DSNSGGTGYAQKFQGRVTMTRDTSTST VYMELSSLRSEDTAVYYCAKEVFSGW YDYWGQGTLVTVSS |
| SEQ ID NO: 132 | AB001866_HV | QVQLVQSGAEVKKPGASVKVSCKASG YTFSNYYVHWVRQAPGQGLEWMGWM DPNSGGTGYAHQFQGRVTMTRDTSTST VYMELSSLRSEDTAVYYCAKEVFSGW YDYWGQGTLVTVSS |
| SEQ ID NO: 133 | AB001875_HV | QVQLVQSGAEVKKPGASVKVSCKASG YTFSNYYIHWVRQAPGQGLEWMGWM DSNGYTGYAQQFQGRVTMTRDTSTST VYMELSSLRSEDTAVYYCAKEVFSGW YDYWGQGTLVTVSS |
| SEQ ID NO: 134 | AB001909_HV | QVQLVQSGAEVKKPGASVKVSCKASG YTFSNYYIHWVRQAPGQGLEWMGWM DSNGGTGYAQKFQGRVTMTRDTSTST VYMELSSLRSEDTAVYYCAKEVFSGW YDYWGQGTLVTVSS |
| SEQ ID NO: 135 | AB001718_LV | DIQMTQSPSSLSASVGDRVTITCRASQYI SSGLAWYQQKPGKAPKLLIYKASSLDN GVPSRFSGSGSGTDFTLTISSLQPEDFAT YYCQQYERLPLTFGGGTKVEIK |
| SEQ ID NO: 136 | AB001744_LV | DIQMTQSPSSLSASVGDRVTITCRASQSI GTGLAWYQQKPGKAPKLLIYKASSLDN GVPSRFSGSGSGTDFTLTISSLQPEDFAT YYCQQYNRAPLTFGGGTKVEIK |
| SEQ ID NO: 137 | AB002022_LV | DIQMTQSPSSLSASVGDRVTITCRASQSI GRWLAWYQQKPGKAPKLLIYSASNLET GVPSRFSGSGSGTDFTLTISSLQPEDFAT YYCQQYESFPVTFGPGTKVDIK |
| SEQ ID NO: 138 | AB001609_LV | DIQMTQSPSSLSASVGDRVTITCRASQSI SNRLAWYQQKPGKAPKLLIYKASSLES GVPSRFSGSGSGTDFTLTISSLQPEDFAT YYCQQSNSTPFTFGQGTKVEIK |
| SEQ ID NO: 139 | AB001638_LV | DIQMTQSPSSLSASVGDRVTITCQASQSI SNYLAWYQQKPGKAPKLLIYKASSLES GVPSRFSGSGSGTDFTLTISSLQPEDFAT YYCQQTYSTPITFGQGTKVEIK |
| SEQ ID NO: 140 | AB001843_LV | DIQMTQSPSSLSASVGDRVTITCRASQSI SSYLNWYQQKPGKAPKLLIYAASSLQS GVPSRFSGSGSGTDFTLTISSLQPEDFAT YYCQQSYSTPYTFGQGTKVEIK |
| SEQ ID NO: 141 | AB001909LV | DIQMTQSPSSLSASVGDRVTITCRASQSI SSYLNWYQQKPGKAPKLLIYAASSLES GVPSRFSGSGSGTDFTLTISSLQPEDFAT YYCQQSYSTPYTFGQGTKVDIK |

TABLE 14-continued

Sequences of DBA Protein Components

| SEQ ID NO: | DBA Protein Component | Sequence |
|---|---|---|
| SEQ ID NO 142 | AB001718_HV_cdr1 | GDTFSTYYVH |
| SEQ ID NO 143 | AB001744_HV_cdr1 | GYTFSNYYIH |
| SEQ ID NO 144 | AB002022_HV_cdr1 | GDTFTRHYVH |
| SEQ ID NO 145 | AB001609_HV_cdr1 | GGTFSSYAIS |
| SEQ ID NO 146 | AB001843_HV_cdr1 | GYTFSGYYIH |
| SEQ ID NO 147 | AB001866_HV_cdr1 | GYTFSNYYVH |
| SEQ ID NO 148 | AB001718_HV_cdr2 | IINPSGGGTVYAQKFQG |
| SEQ ID NO 149 | AB002022_HV_cdr2 | IINPSGGYASYAQKFQG |
| SEQ ID NO 150 | AB001609_HV_cdr2 | IIDPSVTYTRYAQKFQG |
| SEQ ID NO 151 | AB001843_HV_cdr2 | WMDSNSGGTGYAQKFQG |
| SEQ ID NO 152 | AB001866_HV_cdr2 | WMDPNSGGTGYAHQFQG |
| SEQ ID NO 153 | AB001875_HV_cdr2 | WMDSNSGYTGYAQQFQG |
| SEQ ID NO 154 | AB001718_HV_cdr3 | AAGLFI |
| SEQ ID NO 155 | AB001609_HV_cdr3 | ARSLFPTIFGVEVAFDI |
| SEQ ID NO 156 | AB001843_HV_cdr3 | AKEVFSGWYDY |
| SEQ ID NO 157 | AB001718_LV_cdr1 | RASQYISSGLA |
| SEQ ID NO 158 | AB001744_LV_cdr1 | RASQSIGTGLA |
| SEQ ID NO 159 | AB002022_LV_cdr1 | RASQSIGRWLA |
| SEQ ID NO 160 | AB001609_LV_cdr1 | RASQSISNRLA |
| SEQ ID NO 161 | AB001638_LV_cdr1 | QASQSISNYLA |
| SEQ ID NO 162 | AB001843_LV_cdr1 | RASQSISSYLN |
| SEQ ID NO 163 | AB001718_LV_cdr2 | KASSLDN |
| SEQ ID NO 164 | AB002022_LV_cdr2 | SASNLET |
| SEQ ID NO 165 | AB001609_LV_cdr2 | KASSLES |
| SEQ ID NO 166 | AB001843_LV_cdr2 | AASSLQS |
| SEQ ID NO 167 | AB001909_LV_cdr2 | AASSLES |
| SEQ ID NO 168 | AB001718_LV_cdr3 | QQYERLPL |
| SEQ ID NO 169 | AB001744_LV_cdr3 | QQYNRAPL |
| SEQ ID NO 170 | AB002022_LV_cdr3 | QQYESFPV |
| SEQ ID NO 171 | AB001609_LV_cdr3 | QQSNSTPF |
| SEQ ID NO 172 | AB001638_LV_cdr3 | QQTYSTPI |
| SEQ ID NO 173 | AB001843_LV_cdr3 | QQSYSTPY |

TABLE 15

Exemplary DBA-Cytokine Protein Complexes

Figure 9D:
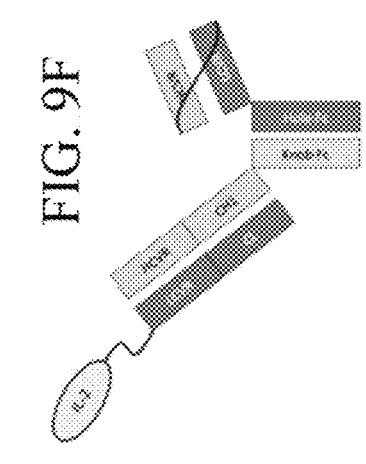
Figure 9E:
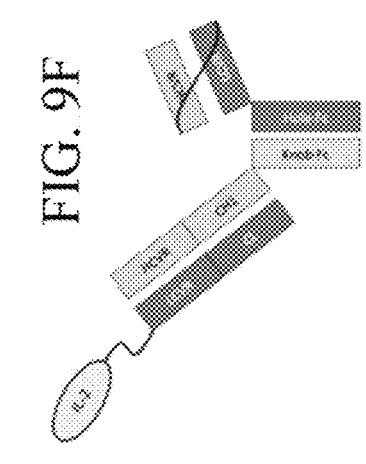
Figure 9F:
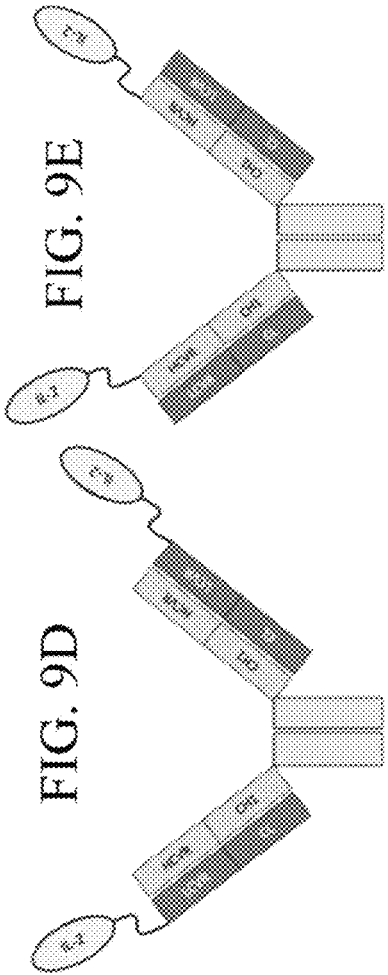
Figure 10:
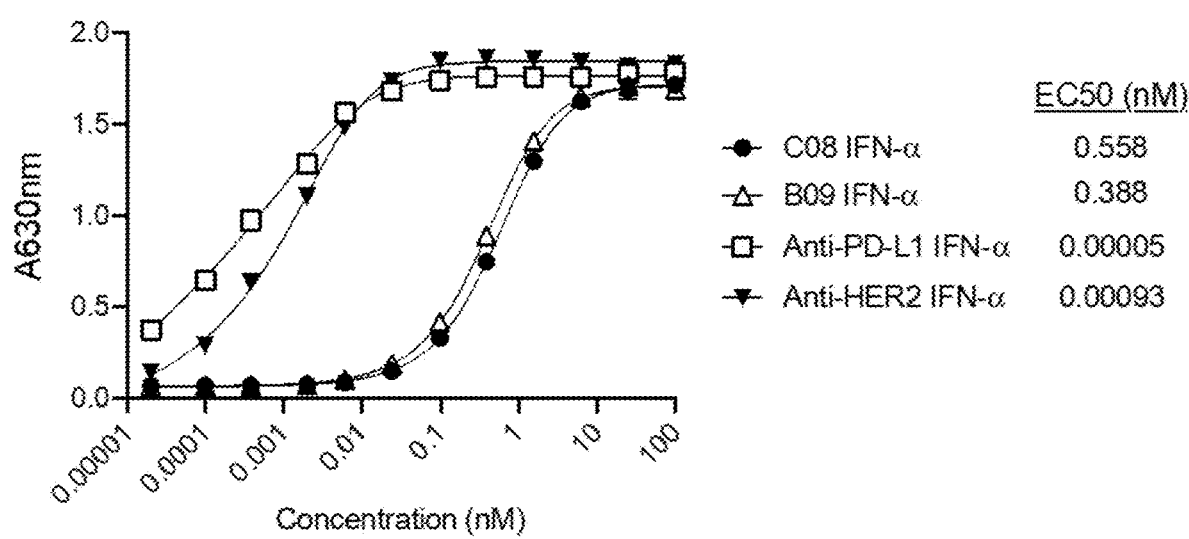
FIG. 10 shows that interferon signaling by two exemplary PD-L1/IFNα DBA cytokine protein complexes (C08 IFNα and B09 IFNα, SEQ ID NO: 57-SEQ ID NO: 58 and SEQ ID NO: 59-SEQ ID NO: 60 respectively) is reduced as compared to two control IFNα-antibody protein complexes (Anti-HER2 IFNα and Anti-PD-L1 IFNα, SEQ ID NO: 63-SEQ ID NO: 64 and SEQ ID NO: 61-SEQ ID NO: 62 respectively).

| Name | DBA/ Therapeutic | DBA | Type | DBA domains | Therapeutic domains | 2nd Ab domain | Heavy Chain 1 SEQID NO: | Heavy Chain 2 SEQID NO: | Heavy Chain 3 SEQID NO: |
|---|---|---|---|---|---|---|---|---|---|
| AF003229 | PD-1/IL-2 | AB001718 | FIG. 9b | 2 | 1 | N/A | 80 | 97 | 114 |
| AF003230 | PD-1/IL-2 | AB001744 | FIG. 9b | 2 | 1 | N/A | 81 | 98 | 115 |
| AF003232 | PD-1/IL-2 | AB002022 | FIG. 9b | 2 | 1 | N/A | 82 | 99 | 116 |
| AF003250 | PD-1/IL-2 | AB001718 | FIG. 9a | 1 | 1 | anti-PD-1 | 83 | 100 | 117 |
| AF003251 | PD-1/IL-2 | AB001744 | FIG. 9a | 1 | 1 | anti-PD-1 | 84 | 101 | 118 |
| AF003253 | PD-1/IL-2 | AB002022 | FIG. 9a | 1 | 1 | anti-PD-1 | 85 | 102 | 119 |
| AF003103 | PD-L1/IFNα | AB001609 | FIG. 9b | 2 | 1 | N/A | 86 | 103 | 120 |
| AF003104 | PD-L1/IFNα | AB001909 | FIG. 9b | 2 | 1 | N/A | 87 | 104 | 126 |
| AF003105 | PD-L1/IFNα | AB001843 | FIG. 9b | 2 | 1 | N/A | 88 | 105 | 122 |
| AF003106 | PD-L1/IFNα | AB001875 | FIG. 9b | 2 | 1 | N/A | 89 | 106 | 123 |
| AF003217 | PD-L1/IFNα | AB001609 | FIG. 9a | 1 | 1 | anti-PD-L1 | 90 | 107 | 124 |
| AF003218 | PD-L1/IFNα | AB001843 | FIG. 9a | 1 | 1 | anti-PD-L1 | 91 | 108 | 125 |
| AF003219 | PD-L1/IFNα | AB001909 | FIG. 9a | 1 | 1 | anti-PD-L1 | 92 | 109 | 126 |
| AF002618 | PD-L1/IFNα | AB001609 | FIG. 9d | 2 | 2 | N/A | 93 | | 110 |
| AF002639 | PD-L1/IFNα | AB001875 | FIG. 9d | 2 | 2 | N/A | 94 | | 111 |
| AF002645 | PD-L1/IFNα | AB001609 | FIG. 9e | 2 | 2 | N/A | 95 | | 112 |
| AF002666 | PD-L1/IFNα | AB001875 | FIG. 9e | 2 | 2 | N/A | 96 | | 277 |

TABLE 16

Sequences of Peptides in TABLE 15

| SEQ ID NO: | DBA | Sequence |
|---|---|---|
| SEQ ID NO: 80 | AF003229_Pep1 | APTSSSTKKTQLQLEHLLLDLQMILNGINNYKNPKLTDMLTF KFYMPKKATELKHLQCLEEELKPLEEVLNLAQSKNFHLRPR DLISNINVIVLELKGSETTFMCEYADETATIVEFLNRWITFCQ SIISTLTGGGGSGGGGSGGGGSGGGGSQVQLVQSGAEVKKP GASVKVSCKASGDTFSTYYVHWVRQAPGQGLEWMGIINPS GGGTVYAQKFQGRVTMTRDTSTSTVYMELSSLRSEDTAVY YCAAGLFIWGQGTLVTVSSAKTTAPSVYPLAPVCGDTTGSS VTLGCLVKGYFPEPVTLTWNSGSLSSGVHTFPAVLQSDLYT LSSSVTVTSSTWPSQSITCNVAHPASSTKVDKKIEPRGPTIKP CPPCKCPAPNAAGGPSVFIFPPKIKDVLMISLSPIVTCVVVDV SEDDPDVQISWFVNNVEVHTAQTQTHREDYNSTLRVVSALP IQHQDWMSGKEFKCKVNNKDLGAPIERTISKPKGSVRAPQV YVLPPPEEEMTKKQVTLTCMVTDFMPEDIYVEWTNNGKTE LNYKNTEPVLDSDGSYFMYSDRVEKKNWVERNSYSCSVV HEGLHNHHTTESFSRTPGK |
| SEQ ID NO: 81 | AF003230_Pep1 | APTSSSTKKTQLQLEHLLLDLQMILNGINNYKNPKLTDMLTF KFYMPKKATELKHLQCLEEELKPLEEVLNLAQSKNFHLRPR DLISNINVIVLELKGSETTFMCEYADETATIVEFLNRWITFCQ SIISTLTGGGGSGGGGSGGGGSGGGGSQVQLVQSGAEVKKP GASVKVSCKASGYTFSNYYIHWVRQAPGQGLEWMGIINPS GGGTVYAQKFQGRVTMTRDTSTSTVYMELSSLRSEDTAVY YCAAGLFIWGQGTLVTVSSAKTTAPSVYPLAPVCGDTTGSS VTLGCLVKGYFPEPVTLTWNSGSLSSGVHTFPAVLQSDLYT LSSSVTVTSSTWPSQSITCNVAHPASSTKVDKKIEPRGPTIKP CPPCKCPAPNAAGGPSVFIFPPKIKDVLMISLSPIVTCVVVDV SEDDPDVQISWFVNNVEVHTAQTQTHREDYNSTLRVVSALP IQHQDWMSGKEFKCKVNNKDLGAPIERTISKPKGSVRAPQV |

TABLE 16-continued

Sequences of Peptides in TABLE 15

| SEQ ID NO: | DBA | Sequence |
|---|---|---|
| | | YVLPPPEEEMTKKQVTLTCMVTDFMPEDIYVEWTNNGKTE LNYKNTEPVLDSDGSYFMYSDLRVEKKNWVERNSYSCSVV HEGLHNHHTTESFSRTPGK |
| SEQ ID NO: 82 | AF003232_Pep1 | APTSSSTKKTQLQLEHLLLDLQMILNGINNYKNPKLTDMLTF KFYMPKKATELKHLQCLEEELKPLEEVLNLAQSKNFHLRPR DLISNINVIVLELKGSETTFMCEYADETATIVEFLNRWITFCQ SIISTLTGGGGSGGGGSGGGGSGGGGSQVQLVQSGAEVKKP GASVKVSCKASGDTFTRHYVHWVRQAPGQGLEWMGIINPS GGYASYAQKFQGRVTMTRDTSTSTVYMELSSLRSEDTAVY YCAAGLFIWGQGTLVTVSSAKTTAPSVYPLAPVCGDTTGSS VTLGCLVKGYFPEPVTLTWNSGSLSSGVHTFPAVLQSDLYT LSSSVTVTSSTWPSQSITCNVAHPASSTKVDKKIEPRGPTIKP CPPCKCPAPNAAGGPSVFIFPPKIKDVLMISLSPIVTCVVVDV SEDDPDVQISWFVNNVEVHTAQTQTHREDYNSTLRVVSALP IQHQDWMSGKEFKCKVNNKDLGAPIERTISKPKGSVRAPQV YVLPPPEEEMTKKQVTLTCMVTDFMPEDIYVEWTNNGKTE LNYKNTEPVLDSDGSYFMYSDLRVEKKNWVERNSYSCSVV HEGLHNHHTTESFSRTPGK |
| SEQ ID NO: 83 | AF003250_Pep1 | APTSSSTKKTQLQLEHLLLDLQMILNGINNYKNPKLTDMLTF KFYMPKKATELKHLQCLEEELKPLEEVLNLAQSKNFHLRPR DLISNINVIVLELKGSETTFMCEYADETATIVEFLNRWITFCQ SIISTLTGGGGSGGGGSGGGGSGGGGSQVQLVQSGAEVKKP GASVKVSCKASGDTFSTYYVHWVRQAPGQGLEWMGIINPS GGGTVYAQKFQGRVTMTRDTSTSTVYMELSSLRSEDTAVY YCAAGLFIWGQGTLVTVSSAKTTAPSVYPLAPVCGDTTGSS VTLGCLVKGYFPEPVTLTWNSGSLSSGVHTFPAVLQSDLYT LSSSVTVTSSTWPSQSITCNVAHPASSTKVDKKIEPRGPTIKP CPPCKCPAPNAAGGPSVFIFPPKIKDVLMISLSPIVTCVVVDV SEDDPDVQISWFVNNVEVHTAQTQTHREDYNSTLRVVSALP IQHQDWMSGKEFKCKVNNKDLGAPIERTISKPKGSVRAPQV YVLPPPEEEMTKKQVTLTCMVTDFMPEDIYVEWTNNGKTE LNYKNTEPVLDSDGSYFMYSDLRVEKKNWVERNSYSCSVV HEGLHNHHTTESFSRTPGK |
| SEQ ID NO: 84 | AF003251_Pep1 | APTSSSTKKTQLQLEHLLLDLQMILNGINNYKNPKLTDMLTF KFYMPKKATELKHLQCLEEELKPLEEVLNLAQSKNFHLRPR DLISNINVIVLELKGSETTFMCEYADETATIVEFLNRWITFCQ SIISTLTGGGGSGGGGSGGGGSGGGGSQVQLVQSGAEVKKP GASVKVSCKASGYTFSNYYIHWVRQAPGQGLEWMGIINPS GGGTVYAQKFQGRVTMTRDTSTSTVYMELSSLRSEDTAVY YCAAGLFIWGQGTLVTVSSAKTTAPSVYPLAPVCGDTTGSS VTLGCLVKGYFPEPVTLTWNSGSLSSGVHTFPAVLQSDLYT LSSSVTVTSSTWPSQSITCNVAHPASSTKVDKKIEPRGPTIKP CPPCKCPAPNAAGGPSVFIFPPKIKDVLMISLSPIVTCVVVDV SEDDPDVQISWFVNNVEVHTAQTQTHREDYNSTLRVVSALP IQHQDWMSGKEFKCKVNNKDLGAPIERTISKPKGSVRAPQV YVLPPPEEEMTKKQVTLTCMVTDFMPEDIYVEWTNNGKTE LNYKNTEPVLDSDGSYFMYSDLRVEKKNWVERNSYSCSVV HEGLHNHHTTESFSRTPGK |
| SEQ ID NO: 85 | AF003253_Pep1 | APTSSSTKKTQLQLEHLLLDLQMILNGINNYKNPKLTDMLTF KFYMPKKATELKHLQCLEEELKPLEEVLNLAQSKNFHLRPR DLISNINVIVLELKGSETTFMCEYADETATIVEFLNRWITFCQ SIISTLTGGGGSGGGGSGGGGSGGGGSQVQLVQSGAEVKKP GASVKVSCKASGDTFTRHYVHWVRQAPGQGLEWMGIINPS GGYASYAQKFQGRVTMTRDTSTSTVYMELSSLRSEDTAVY YCAAGLFIWGQGTLVTVSSAKTTAPSVYPLAPVCGDTTGSS VTLGCLVKGYFPEPVTLTWNSGSLSSGVHTFPAVLQSDLYT LSSSVTVTSSTWPSQSITCNVAHPASSTKVDKKIEPRGPTIKP CPPCKCPAPNAAGGPSVFIFPPKIKDVLMISLSPIVTCVVVDV SEDDPDVQISWFVNNVEVHTAQTQTHREDYNSTLRVVSALP IQHQDWMSGKEFKCKVNNKDLGAPIERTISKPKGSVRAPQV YVLPPPEEEMTKKQVTLTCMVTDFMPEDIYVEWTNNGKTE LNYKNTEPVLDSDGSYFMYSDLRVEKKNWVERNSYSCSVV HEGLHNHHTTESFSRTPGK |
| SEQ ID NO: 86 | AF003103_Pep1 | CDLPQTHSLGSRRTLMLLAQMRRISLFSCLKDRHDFGFPQEE FGNQFQKAETIPVLHEMIQQIFNLFSTKDSSAAWDETLLDKF CTELYQQLNDLEACVMQEERVGETPLMNADSILAVKKYFR RITLYLTEKKYSPCAWEVVRAEIVRSLSLSTNLQERLRRKEG GGGSGGGGSGGGGSGGGGSQVQLVQSGAEVKKPGASVKV SCKASGGTFSSYAISWVRQAPGQGLEWMGIDPSVTYTRYA QKFQGRVTMTRDTSTSTVYMELSSLRSEDTAVYYCARSLFP |

TABLE 16-continued

Sequences of Peptides in TABLE 15

| SEQ ID NO: | DBA | Sequence |
|---|---|---|
| | | TIFGVEVAFDIWGQGTLVTVSSAKTTAPSVYPLAPVCGDTT GSSVTLGCLVKGYFPEPVTLTWNSGSLSSGVHTFPAVLQSD LYTLSSSVTVTSSTWPSQSITCNVAHPASSTKVDKKIEPGPT IKPCPPCKCPAPNAAGGPSVFIFPPKIKDVLMISLSPIVTCVVV DVSEDDPDVQISWFVNNVEVHTAQTQTHREDYNSTLRVVS ALPIQHQDWMSGKEFKCKVNNKDLGAPIERTISKPKGSVRA PQVCVLPPPEEEMTKKQVTLWCMVTDFMPEDIYVEWTNNG KTELNYKNTEPVLDSDGSYFMYSKLRVEKKNWVERNSYSC SVVHEGLHNHHTTKSFSRTPGK |
| SEQ ID NO: 87 | AF003104_Pep1 | CDLPQTHSLGSRRTLMLLAQMRRISLFSCLKDRHDFGFPQEE FGNQFQKAETIPVLHEMIQQIFNLFSTKDSSAAWDETLLDKF CTELYQQLNDLEACVMQEERVGETPLMNADSILAVKKYFR RITLYLTEKKYSPCAWEVVRAEIVRSLSLSTNLQERLRRKEG GGGSGGGGSGGGGSGGGGS QVQLVQSGAEVKKPGASVKVSCKASGYTFSNYYIHWVRQA PGQGLEWMGWMDSNSGGTGYAQKFQGRVTMTRDTSTSTV YMELSSLRSEDTAVYYCAKEVFSGWYDYWGQGTLVTVSS AKTTAPSVYPLAPVCGDTTGSSVTLGCLVKGYFPEPVTLTW NSGSLSSGVHTFPAVLQSDLYTLSSSVTVTSSTWPSQSITCNV AHPASSTKVDKKIEPRGPTIKPCPPCKCPAPNAAGGPSVFIFP PKIKDVLMISLSPIVTCVVVDVSEDDPDVQISWFVNNVEVHT AQTQTHREDYNSTLRVVSALPIQHQDWMSGKEFKCKVNNK DLGAPIERTISKPKGSVRAPQVCVLPPPEEEMTKKQVTLWC MVTDFMPEDIYVEWTNNGKTELNYKNTEPVLDSDGSYFMY SKLRVEKKNWVERNSYSCSVVHEGLHNHHTTKSFSRTPGK |
| SEQ ID NO: 88 | AF003105_Pep1 | CDLPQTHSLGSRRTLMLLAQMRRISLFSCLKDRHDFGFPQEE FGNQFQKAETIPVLHEMIQQIFNLFSTKDSSAAWDETLLDKF CTELYQQLNDLEACVMQEERVGETPLMNADSILAVKKYFR RITLYLTEKKYSPCAWEVVRAEIVRSLSLSTNLQERLRRKEG GGGSGGGGSGGGGSGGGGSQVQLVQSGAEVKKPGASVKV SCKASGYTFSGYYIHWVRQAPGQGLEWMGWMDSNSGGTG YAQKFQGRVTMTRDTSTSTVYMELSSLRSEDTAVYYCAKE VFSGWYDYWGQGTLVTVSSAKTTAPSVYPLAPVCGDTTGS SVTLGCLVKGYFPEPVTLTWNSGSLSSGVHTFPAVLQSDLY TLSSSVTVTSSTWPSQSITCNVAHPASSTKVDKKIEPRGPTIK PCPPCKCPAPNAAGGPSVFIFPPKIKDVLMISLSPIVTCVVVD VSEDDPDVQISWFVNNVEVHTAQTQTHREDYNSTLRVVSA LPIQHQDWMSGKEFKCKVNNKDLGAPIERTISKPKGSVRAP QVCVLPPPEEEMTKKQVTLWCMVTDFMPEDIYVEWTNNG KTELNYKNTEPVLDSDGSYFMYSKLRVEKKNWVERNSYSC SVVHEGLHNHHTTKSFSRTPGK |
| SEQ ID NO: 89 | AF003106_Pep1 | CDLPQTHSLGSRRTLMLLAQMRRISLFSCLKDRHDFGFPQEE FGNQFQKAETIPVLHEMIQQIFNLFSTKDSSAAWDETLLDKF CTELYQQLNDLEACVMQEERVGETPLMNADSILAVKKYFR RITLYLTEKKYSPCAWEVVRAEIVRSLSLSTNLQERLRRKEG GGGSGGGGSGGGGSGGGGSQVQLVQSGAEVKKPGASVKV SCKASGYTFSNYYIHWVRQAPGQGLEWMGWMDSNSGYTG YAQQFQGRVTMTRDTSTSTVYMELSSLRSEDTAVYYCAKE VFSGWYDYWGQGTLVTVSSAKTTAPSVYPLAPVCGDTTGS SVTLGCLVKGYFPEPVTLTWNSGSLSSGVHTFPAVLQSDLY TLSSSVTVTSSTWPSQSITCNVAHPASSTKVDKKIEPRGPTIK PCPPCKCPAPNAAGGPSVFIFPPKIKDVLMISLSPIVTCVVVD VSEDDPDVQISWFVNNVEVHTAQTQTHREDYNSTLRVVSA LPIQHQDWMSGKEFKCKVNNKDLGAPIERTISKPKGSVRAP QVCVLPPPEEEMTKKQVTLWCMVTDFMPEDIYVEWTNNG KTELNYKNTEPVLDSDGSYFMYSKLRVEKKNWVERNSYSC SVVHEGLHNHHTTKSFSRTPGK |
| SEQ ID NO: 90 | AF003217_Pep1 | CDLPQTHSLGSRRTLMLLAQMRRISLFSCLKDRHDFGFPQEE FGNQFQKAETIPVLHEMIQQIFNLFSTKDSSAAWDETLLDKF CTELYQQLNDLEACVMQEERVGETPLMNADSILAVKKYFR RITLYLTEKKYSPCAWEVVRAEIVRSLSLSTNLQERLRRKEG GGGSGGGGSGGGGSGGGGSQVQLVQSGAEVKKPGASVKV SCKASGGTFSSYAISWVRQAPGQGLEWMGIIDPSVTYTRYA QKFQGRVTMTRDTSTSTVYMELSSLRSEDTAVYYCARSLFP TIFGVEVAFDIWGQGTLVTVSSAKTTAPSVYPLAPVCGDTT GSSVTLGCLVKGYFPEPVTLTWNSGSLSSGVHTFPAVLQSD LYTLSSSVTVTSSTWPSQSITCNVAHPASSTKVDKKIEPRGPT IKPCPPCKCPAPNAAGGPSVFIFPPKIKDVLMISLSPIVTCVVV DVSEDDPDVQISWFVNNVEVHTAQTQTHREDYNSTLRVVS |

TABLE 16-continued

Sequences of Peptides in TABLE 15

| SEQ ID NO: | DBA | Sequence |
|---|---|---|
| | | ALPIQHQDWMSGKEFKCKVNNKDLGAPIERTISKPKGSVRA
PQVCVLPPPEEEMTKKQVTLWCMVTDFMPEDIYVEWTNNG
KTELNYKNTEPVLDSDGSYFMYSKLRVEKKNWVERNSYSC
SVVHEGLHNHHTTKSFSRTPGK |
| SEQ ID NO: 91 | AF003218_Pep1 | CDLPQTHSLGSRRTLMLLAQMRRISLFSCLKDRHDFGFPQEE
FGNQFQKAETIPVLHEMIQQIFNLFSTKDSSAAWDETLLDKF
CTELYQQLNDLEACVMQEERVGETPLMNADSILAVKKYFR
RITLYLTEKKYSPCAWEVVRAEIVRSLSLSTNLQERLRRKEG
GGGSGGGGSGGGGSGGGGSQVQLVQSGAEVKKPGASVKV
SCKASGYTFSGYYIHWVRQAPGQGLEWMGWMDSNSGGTG
YAQKFQGRVTMTRDTSTSTVYMELSSLRSEDTAVYYCAKE
VFSGWYDYWGQGTLVTVSSAKTTAPSVYPLAPVCGDTTGS
SVTLGCLVKGYFPEPVTLTWNSGSLSSGVHTFPAVLQSDLY
TLSSSVTVTSSTWPSQSITCNVAHPASSTKVDKKIEPRGPTIK
PCPPCKCPAPNAAGGPSVFIFPPKIKDVLMISLSPIVTCVVVD
VSEDDPDVQISWFVNNVEVHTAQTQTHREDYNSTLRVVSA
LPIQHQDWMSGKEFKCKVNNKDLGAPIERTISKPKGSVRAP
QVCVLPPPEEEMTKKQVTLWCMVTDFMPEDIYVEWTNNG
KTELNYKNTEPVLDSDGSYFMYSKLRVEKKNWVERNSYSC
SVVHEGLHNHHTTKSFSRTPGK |
| SEQ ID NO: 92 | AF003219_Pep1 | CDLPQTHSLGSRRTLMLLAQMRRISLFSCLKDRHDFGFPQEE
FGNQFQKAETIPVLHEMIQQIFNLFSTKDSSAAWDETLLDKF
CTELYQQLNDLEACVMQEERVGETPLMNADSILAVKKYFR
RITLYLTEKKYSPCAWEVVRAEIVRSLSLSTNLQERLRRKEG
GGGSGGGGSGGGGSGGGGSQVQLVQSGAEVKKPGASVKV
SCKASGYTFSNYYIHWVRQAPGQGLEWMGWMDSNSGGTG
YAQKFQGRVTMTRDTSTSTVYMELSSLRSEDTAVYYCAKE
VFSGWYDYWGQGTLVTVSSAKTTAPSVYPLAPVCGDTTGS
SVTLGCLVKGYFPEPVTLTWNSGSLSSGVHTFPAVLQSDLY
TLSSSVTVTSSTWPSQSITCNVAHPASSTKVDKKIEPRGPTIK
PCPPCKCPAPNAAGGPSVFIFPPKIKDVLMISLSPIVTCVVVD
VSEDDPDVQISWFVNNVEVHTAQTQTHREDYNSTLRVVSA
LPIQHQDWMSGKEFKCKVNNKDLGAPIERTISKPKGSVRAP
QVCVLPPPEEEMTKKQVTLWCMVTDFMPEDIYVEWTNNG
KTELNYKNTEPVLDSDGSYFMYSKLRVEKKNWVERNSYSC
SVVHEGLHNHHTTKSFSRTPGK |
| SEQ ID NO: 93 | AF002618_Pep1 | QVQLVQSGAEVKKPGASVKVSCKASGGTFSSYAISWVRQA
PGQGLEWMGIIDPSVTYTRYAQKFQGRVTMTRDTSTSTVY
MELSSLRSEDTAVYYCARSLFPTIFGVEVAFDIWGQGTLVTV
SSAKTTAPSVYPLAPVCGDTTGSSVTLGCLVKGYFPEPVTLT
WNSGSLSSGVHTFPAVLQSDLYTLSSSVTVTSSTWPSQSITC
NVAHPASSTKVDKKIEPRGPTIKPCPPCKCPAPNAAGGPSVFI
FPPKIKDVLMISLSPIVTCVVVDVSEDDPDVQISWFVNNVEV
HTAQTQTHREDYNSTLRVVSALPIQHQDWMSGKEFKCKVN
NKDLGAPIERTISKPKGSVRAPQVYVLPPPEEEMTKKQVTLT
CMVTDFMPEDIYVEWTNNGKTELNYKNTEPVLDSDGSYFM
YSKLRVEKKNWVERNSYSCSVVHEGLHNHHTTKSFSRTPG
K |
| SEQ ID NO: 94 | AF002639_Pep1 | QVQLVQSGAEVKKPGASVKVSCKASGYTFSNYYIHWVRQA
PGQGLEWMGWMDSNSGYTGYAQQFQGRVTMTRDTSTSTV
YMELSSLRSEDTAVYYCAKEVFSGWYDYWGQGTLVTVSSA
KTTAPSVYPLAPVCGDTTGSSVTLGCLVKGYFPEPVTLTWN
SGSLSSGVHTFPAVLQSDLYTLSSSVTVTSSTWPSQSITCNVA
HPASSTKVDKKIEPRGPTIKPCPPCKCPAPNAAGGPSVFIFPP
KIKDVLMISLSPIVTCVVVDVSEDDPDVQISWFVNNVEVHT
AQTQTHREDYNSTLRVVSALPIQHQDWMSGKEFKCKVNNK
DLGAPIERTISKPKGSVRAPQVYVLPPPEEEMTKKQVTLTCM
VTDFMPEDIYVEWTNNGKTELNYKNTEPVLDSDGSYFMYS
KLRVEKKNWVERNSYSCSVVHEGLHNHHTTKSFSRTPGK |
| SEQ ID NO: 95 | AF002645_Pep1 | CDLPQTHSLGSRRTLMLLAQMRRISLFSCLKDRHDFGFPQEE
FGNQFQKAETIPVLHEMIQQIFNLFSTKDSSAAWDETLLDKF
YTELYQQLNDLEACVIQGVGVTETPLMKEDSILAVRKYFQR
ITLYLKEKKYSPCAWEVVRAEIMRSFSLSTNLQESLRSKEVP
GVGVPGAGVPGVGVPGGGVPGVGVPGGGVPGAGVPGGGV
PGVGVPGAGVPGVGVPGGGQVQLVQSGAEVKKPGASVKV
SCKASGGTFSSYAISWVRQAPGQGLEWMGIIDPSVTYTRYA
QKFQGRVTMTRDTSTSTVYMELSSLRSEDTAVYYCARSLFP
TIFGVEVAFDIWGQGTLVTVSSAKTTAPSVYPLAPVCGDTT
GSSVTLGCLVKGYFPEPVTLTWNSGSLSSGVHTFPAVLQSD
LYTLSSSVTVTSSTWPSQSITCNVAHPASSTKVDKKIEPRGPT |

TABLE 16-continued

Sequences of Peptides in TABLE 15

| SEQ ID NO: | DBA | Sequence |
|---|---|---|
| | | IKPCPPCKCPAPNAAGGPSVFIFPPKIKDVLMISLSPIVTCVVV DVSEDDPDVQISWFVNNVEVHTAQTQTHREDYNSTLRVVS ALPIQHQDWMSGKEFKCKVNNKDLGAPIERTISKPKGSVRA PQVYVLPPPEEEMTKKQVTLTCMVTDFMPEDIYVEWTNNG KTELNYKNTEPVLDSDGSYFMYSKLRVEKKNWVERNSYSC SVVHEGLHNHHTTKSFSRTPGK |
| SEQ ID NO: 96 | AF002666_Pep1 | CDLPQTHSLGSRRTLMLLAQMRRISLFSCLKDRHDFGFPQEE FGNQFQKAETIPVLHEMIQQIFNLFSTKDSSAAWDETLLDKF YTELYQQLNDLEACVIQGVGVTETPLMKEDSILAVRKYFQR ITLYLKEKKYSPCAWEVVRAEIMRSFSLSTNLQESLRSKEVP GVGVPGAGVPGVGVPGGGVPGVGVPGGGVPGAGVPGGGV PGVGVPGAGVPGVGVPGGGQVQLVQSGAEVKKPGASVKV SCKASGYTFSNYYIHWVRQAPGQGLEWMGWMDSNSGYTG YAQQFQGRVTMTRDTSTSTVYMELSSLRSEDTAVYYCAKE VFSGWYDYWGQGTLVTVSSAKTTAPSVYPLAPVCGDTTGS SVTLGCLVKGYFPEPVTLTWNSGSLSSGVHTFPAVLQSDLY TLSSSVTVTSSTWPSQSITCNVAHPASSTKVDKKIEPRGPTIK PCPPCKCPAPNAAGGPSVFIFPPKIDVLMISLSPIVTCVVVD VSEDDPDVQISWFVNNVEVHTAQTQTHREDYNSTLRVVSA LPIQHQDWMSGKEFKCKVNNKDLGAPIERTISKPKGSVRAP QVYVLPPPEEEMTKKQVTLTCMVTDFMPEDIYVEWTNNGK TELNYKNTEPVLDSDGSYFMYSKLRVEKKNWVERNSYSCS VVHEGLHNHHTTKSFSRTPGK |
| SEQ ID NO: 97 | AF003229_Pep2 | QVQLVQSGAEVKKPGASVKVSCKASGDTFSTYYVHWVRQ APGQGLEWMGIINPSGGGTVYAQKFQGRVTMTRDTSTSTV YMELSSLRSEDTAVYYCAAGLFIWGQGTLVTVSSAKTTAPS VYPLAPVCGDTTGSSVTLGCLVKGYFPEPVTLTWNSGSLSS GVHTFPAVLQSDLYTLSSSVTVTSSTWPSQSITCNVAHPASS TKVDKKIEPRGPTIKPCPPCKCPAPNAAGGPSVFIFPPKIKDV LMISLSPIVTCVVVDVSEDDPDVQISWFVNNVEVHTAQTQT HREDYNSTLRVVSALPIQHQDWMSGKEFKCKVNNKDLGAP IERTISKPKGSVRAPQVYVLPPPEKEMTKKQVSLTCLVKDFM PEDIYVEWTNNGKTELNYKNTEPVLKSDGSYFMYSKLTVE KKNWVERNSYSCSVVHEGLHNHHTTKSFSRTPGGGSGGG SHHHHHH |
| SEQ ID NO: 98 | AF003230_Pep2 | QVQLVQSGAEVKKPGASVKVSCKASGYTFSNYYIHWVRQA PGQGLEWMGIINPSGGGTVYAQKFQGRVTMTRDTSTSTVY MELSSLRSEDTAVYYCAAGLFIWGQGTLVTVSSAKTTAPSV YPLAPVCGDTTGSSVTLGCLVKGYFPEPVTLTWNSGSLSSG VHTFPAVLQSDLYTLSSSVTVTSSTWPSQSITCNVAHPASST KVDKKIEPRGPTIKPCPPCKCPAPNAAGGPSVFIFPPKIKDVL MISLSPIVTCVVVDVSEDDPDVQISWFVNNVEVHTAQTQTH REDYNSTLRVVSALPIQHQDWMSGKEFKCKVNNKDLGAPI ERTISKPKGSVRAPQVYVLPPPEKEMTKKQVSLTCLVKDFM PEDIYVEWTNNGKTELNYKNTEPVLKSDGSYFMYSKLTVE KKNWVERNSYSCSVVHEGLHNHHTTKSFSRTPGGGSGGG SHHHHHH |
| SEQ ID NO: 99 | AF003232_Pep2 | QVQLVQSGAEVKKPGASVKVSCKASGDTFTRHYVHWVRQ APGQGLEWMGIINPSGGYASYAQKFQGRVTMTRDTSTSTV YMELSSLRSEDTAVYYCAAGLFIWGQGTLVTVSSAKTTAPS VYPLAPVCGDTTGSSVTLGCLVKGYFPEPVTLTWNSGSLSS GVHTFPAVLQSDLYTLSSSVTVTSSTWPSQSITCNVAHPASS TKVDKKIEPRGPTIKPCPPCKCPAPNAAGGPSVFIFPPKIKDV LMISLSPIVTCVVVDVSEDDPDVQISWFVNNVEVHTAQTQT HREDYNSTLRVVSALPIQHQDWMSGKEFKCKVNNKDLGAP IERTISKPKGSVRAPQVYVLPPPEKEMTKKQVSLTCLVKDFM PEDIYVEWTNNGKTELNYKNTEPVLKSDGSYFMYSKLTVE KKNWVERNSYSCSVVHEGLHNHHTTKSFSRTPGGGSGGG SHHHHHH |
| SEQ ID NO: 100 | AF003250_Pep2 | QVQLVQSGAEVKKPGASVKVSCKASGYTFTTYYVHWVRQ APGQGLEWMGIINPSGGSTSYAQNFQGRVTMTRDTSTSTVY MELSSLRSEDTAVYYCASGWDVWGQGTTVTVSSASGGGGS GGGSGGGGSHASEIVMTQSPATLSVSPGERATLSCRASQS VNTYLAWYQQKPGQAPRLLIYGASTRATGIPARFSGSGSGT EFTLTISSLQSEDFAVYYCQQYGSSPVTFGQGTRLEIKPRGPT IKPCPPCKCPAPNAAGGPSVFIFPPKIDVLMISLSPIVTCVVV DVSEDDPDVQISWFVNNVEVHTAQTQTHREDYNSTLRVVS |

TABLE 16-continued

Sequences of Peptides in TABLE 15

| SEQ ID NO: | DBA | Sequence |
|---|---|---|
| | | ALPIQHQDWMSGKEFKCKVNNKDLGAPIERTISKPKGSVRA PQVYVLPPPEKEMTKKQVSLTCLVKDFMPEDIYVEWTNNG KTELNYKNTEPVLKSDGSYFMYSKLTVEKKNWVERNSYSC SVVHEGLHNHHTTKSFSRTPGGGGSGGGSHHHHHH |
| SEQ ID NO: 101 | AF003251_Pep2 | QVQLVQSGAEVKKPGASVKVSCKASGYTFTTYYVHWVRQ APGQGLEWMGIINPSGGSTSYAQNFQGRVTMTRDTSTSTVY MELSSLRSEDTAVYYCASGWDVWGQGTTVTVSSASGGGGS GGGGSGGGGSHASEIVMTQSPATLSVSPGERATLSCRASQS VNTYLAWYQQKPGQAPRLLIYGASTRATGIPARFSGSGSGT EFTLTISSLQSEDFAVYYCQQYGSSPVTFGQGTRLEIKPRGPT IKPCPPCKCPAPNAAGGPSVFIFPPKIKDVLMISLSPIVTCVVV DVSEDDPDVQISWFVNNVEVHTAQTQTHREDYNSTLRVVS ALPIQHQDWMSGKEFKCKVNNKDLGAPIERTISKPKGSVRA PQVYVLPPPEKEMTKKQVSLTCLVKDFMPEDIYVEWTNNG KTELNYKNTEPVLKSDGSYFMYSKLTVEKKNWVERNSYSC SVVHEGLHNHHTTKSFSRTPGGGGSGGGSHHHHHH |
| SEQ ID NO: 102 | AF003253_Pep2 | QVQLVQSGAEVKKPGASVKVSCKASGYTFTTYYVHWVRQ APGQGLEWMGIINPSGGSTSYAQNFQGRVTMTRDTSTSTVY MELSSLRSEDTAVYYCASGWDVWGQGTTVTVSSASGGGGS GGGGSGGGGSHASEIVMTQSPATLSVSPGERATLSCRASQS VNTYLAWYQQKPGQAPRLLIYGASTRATGIPARFSGSGSGT EFTLTISSLQSEDFAVYYCQQYGSSPVTFGQGTRLEIKPRGPT IKPCPPCKCPAPNAAGGPSVFIFPPKIKDVLMISLSPIVTCVVV DVSEDDPDVQISWFVNNVEVHTAQTQTHREDYNSTLRVVS ALPIQHQDWMSGKEFKCKVNNKDLGAPIERTISKPKGSVRA PQVYVLPPPEKEMTKKQVSLTCLVKDFMPEDIYVEWTNNG KTELNYKNTEPVLKSDGSYFMYSKLTVEKKNWVERNSYSC SVVHEGLHNHHTTKSFSRTPGGGGSGGGSHHHHHH |
| SEQ ID NO: 103 | AF003103_Pep2 | QVQLVQSGAEVKKPGASVKVSCKASGGTFSSYAISWVRQA PGQGLEWMGIIDPSVTYTRYAQKFQGRVTMTRDTSTSTVY MELSSLRSEDTAVYYCARSLFPTIFGVEVAFDIWGQGTLVTV SSAKTTAPSVYPLAPVCGDTTGSSVTLGCLVKGYFPEPVTLT WNSGSLSSGVHTFPAVLQSDLYTLSSSVTVTSSTWPSQSITC NVAHPASSTKVDKKIEPRGPTIKPCPPCKCPAPNAAGGPSVFI FPPKIKDVLMISLSPIVTCVVVDVSEDDPDVQISWFVNNVEV HTAQTQTHREDYNSTLRVVSALPIQHQDWMSGKEFKCKVN NKDLGAPIERTISKPKGSVRAPQVYVLPPCEEEMTKKQVTLS CAVTDFMPEDIYVEWTNNGKTELNYKNTEPVLDSDGSYFM VSKLRVEKKNWVERNSYSCSVVHEGLHNHHTTKSFSRTPG KHHHHHH |
| SEQ ID NO: 104 | AF003104_Pep2 | QVQLVQSGAEVKKPGASVKVSCKASGYTFSNYYIHWVRQA PGQGLEWMGWMDSNSGGTGYAQKFQGRVTMTRDTSTSTV YMELSSLRSEDTAVYYCAKEVFSGWYDYWGQGTLVTVSSA KTTAPSVYPLAPVCGDTTGSSVTLGCLVKGYFPEPVTLTWN SGSLSSGVHTFPAVLQSDLYTLSSSVTVTSSTWPSQSITCNVA HPASSTKVDKKIEPRGPTIKPCPPCKCPAPNAAGGPSVFIFPP KIKDVLMISLSPIVTCVVVDVSEDDPDVQISWFVNNVEVHT AQTQTHREDYNSTLRVVSALPIQHQDWMSGKEFKCKVNNK DLGAPIERTISKPKGSVRAPQVYVLPPCEEEMTKKQVTLSCA VTDFMPEDIYVEWTNNGKTELNYKNTEPVLDSDGSYFMVS KLRVEKKNWVERNSYSCSVVHEGLHNHHTTKSFSRTPGKH HHHHH |
| SEQ ID NO: 105 | AF003105_Pep2 | QVQLVQSGAEVKKPGASVKVSCKASGYTFSGYYIHWVRQA PGQGLEWMGWMDSNSGGTGYAQKFQGRVTMTRDTSTSTV YMELSSLRSEDTAVYYCAKEVFSGWYDYWGQGTLVTVSSA KTTAPSVYPLAPVCGDTTGSSVTLGCLVKGYFPEPVTLTWN SGSLSSGVHTFPAVLQSDLYTLSSSVTVTSSTWPSQSITCNVA HPASSTKVDKKIEPRGPTIKPCPPCKCPAPNAAGGPSVFIFPP KIKDVLMISLSPIVTCVVVDVSEDDPDVQISWFVNNVEVHT AQTQTHREDYNSTLRVVSALPIQHQDWMSGKEFKCKVNNK DLGAPIERTISKPKGSVRAPQVYVLPPCEEEMTKKQVTLSCA VTDFMPEDIYVEWTNNGKTELNYKNTEPVLDSDGSYFMVS KLRVEKKNWVERNSYSCSVVHEGLHNHHTTKSFSRTPGKH HHHHH |
| SEQ ID NO: 106 | AF003106_Pep2 | QVQLVQSGAEVKKPGASVKVSCKASGYTFSNYYIHWVRQA PGQGLEWMGWMDSNSGYTGYAQQFQGRVTMTRDTSTSTV YMELSSLRSEDTAVYYCAKEVFSGWYDYWGQGTLVTVSSA KTTAPSVYPLAPVCGDTTGSSVTLGCLVKGYFPEPVTLTWN SGSLSSGVHTFPAVLQSDLYTLSSSVTVTSSTWPSQSITCNVA |

TABLE 16-continued

Sequences of Peptides in TABLE 15

| SEQ ID NO: | DBA | Sequence |
|---|---|---|
| | | HPASSTKVDKKIEPRGPTIKPCPPCKCPAPNAAGGPSVFIFPP KIKDVLMISLSPIVTCVVVDVSEDDPDVQISWFVNNVEVHT AQTQTHREDYNSTLRVVSALPIQHQDWMSGKEFKCKVNNK DLGAPIERTISKPKGSVRAPQVYVLPPCEEEMTKKQVTLSCA VTDFMPEDIYVEWTNNGKTELNYKNTEPVLDSDGSYFMVS KLRVEKKNWVERNSYSCSVVHEGLHNHHTTKSFSRTPGKH HHHHH |
| SEQ ID NO: 107 | AF003217_Pep2 | QVQLVQSGAEVKKPGASVKVSCKASGYTFTKNYMHWVRQ APGQGLEWLGWVSPDSGYTGYAQKFQGRVTMTRDTSTSTV YMELSSLRSEDTAVYYCTTDLLSLELDDAFDIWGQGTMVT VSSASGGGGSGGGGSGGGGSHASDIQMTQSPSSLSASVGDR VTITCRASQSISSWLAWYQQKPGKAPKLLIYAASTLQSGVPS RFSGSGSGTDFTLTISSLQPEDFATYYCQQSYSTPLTFGGGTK LEIKPRGPTIKPCPPCKCPAPNAAGGPSVFIFPPPKIKDVLMISL SPIVTCVVVDVSEDDPDVQISWFVNNVEVHTAQTQTHREDY NSTLRVVSALPIQHQDWMSGKEFKCKVNNKDLGAPIERTIS KPKGSVRAPQVYVLPPCEEEMTKKQVTLSCAVTDFMPEDIY VEWTNNGKTELNYKNTEPVLDSDGSYFMVSKLRVEKKNW VERNSYSCSVVHEGLHNHHTTKSFSRTPGK |
| SEQ ID NO: 108 | AF003218_Pep2 | QVQLVQSGAEVKKPGASVKVSCKASGYTFTKNYMHWVRQ APGQGLEWLGWVSPDSGYTGYAQKFQGRVTMTRDTSTSTV YMELSSLRSEDTAVYYCTTDLLSLELDDAFDIWGQGTMVT VSSASGGGGSGGGGSGGGGSHASDIQMTQSPSSLSASVGDR VTITCRASQSISSWLAWYQQKPGKAPKLLIYAASTLQSGVPS RFSGSGSGTDFTLTISSLQPEDFATYYCQQSYSTPLTFGGGTK LEIKPRGPTIKPCPPCKCPAPNAAGGPSVFIFPPPKIKDVLMISL SPIVTCVVVDVSEDDPDVQISWFVNNVEVHTAQTQTHREDY NSTLRVVSALPIQHQDWMSGKEFKCKVNNKDLGAPIERTIS KPKGSVRAPQVYVLPPCEEEMTKKQVTLSCAVTDFMPEDIY VEWTNNGKTELNYKNTEPVLDSDGSYFMVSKLRVEKKNW VERNSYSCSVVHEGLHNHHTTKSFSRTPGK |
| SEQ ID NO: 109 | AF003219_Pep2 | QVQLVQSGAEVKKPGASVKVSCKASGYTFTKNYMHWVRQ APGQGLEWLGWVSPDSGYTGYAQKFQGRVTMTRDTSTSTV YMELSSLRSEDTAVYYCTTDLLSLELDDAFDIWGQGTMVT VSSASGGGGSGGGGSGGGGSHASDIQMTQSPSSLSASVGDR VTITCRASQSISSWLAWYQQKPGKAPKLLIYAASTLQSGVPS RFSGSGSGTDFTLTISSLQPEDFATYYCQQSYSTPLTFGGGTK LEIKPRGPTIKPCPPCKCPAPNAAGGPSVFIFPPPKIKDVLMISL SPIVTCVVVDVSEDDPDVQISWFVNNVEVHTAQTQTHREDY NSTLRVVSALPIQHQDWMSGKEFKCKVNNKDLGAPIERTIS KPKGSVRAPQVYVLPPCEEEMTKKQVTLSCAVTDFMPEDIY VEWTNNGKTELNYKNTEPVLDSDGSYFMVSKLRVEKKNW VERNSYSCSVVHEGLHNHHTTKSFSRTPGK |
| SEQ ID NO: 110 | AF002618_Pep2 | CDLPQTHSLGSRRTLMLLAQMRRISLFSCLKDRHDFGFPQEE FGNQFQKAETIPVLHEMIQQIFNLFSTKDSSAAWDETLLDKF YTELYQQLNDLEACVIQGVGVTETPLMKEDSILAVRKYFQR ITLYLKEKKYSPCAWEVVRAEIMRSFSLSTNLQESLRSKEGG GGSGGGGSGGGGSGGGGSDIQMTQSPSSLSASVGDRVTITC RASQSISNRLAWYQQKPGKAPKLLIYKASSLESGVPSRFSGS GSGTDFTLTISSLQPEDFATYYCQQSNSTPFTFGQGTKVEIKR ADAAPTVSIFPPSSEQLTSGGASVVCFLNNFYPKDINVKWKI DGSERQNGVLNSWTDQDSKDSTYSMSSTLTLTKDEYERHN SYTCEATHKTSTSPIVKSFNRNEC |
| SEQ ID NO: 111 | AF002639_Pep2 | CDLPQTHSLGSRRTLMLLAQMRRISLFSCLKDRHDFGFPQEE FGNQFQKAETIPVLHEMIQQIFNLFSTKDSSAAWDETLLDKF YTELYQQLNDLEACVIQGVGVTETPLMKEDSILAVRKYFQR ITLYLKEKKYSPCAWEVVRAEIMRSFSLSTNLQESLRSKEGG GGSGGGGSGGGGSGGGGSDIQMTQSPSSLSASVGDRVTITC RASQSISSYLNWYQQKPGKAPKLLIYAASSLQSGVPSRFSGS GSGTDFTLTISSLQPEDFATYYCQQSYSTPYTFGQGTKVEIK RADAAPTVSIFPPSSEQLTSGGASVVCFLNNFYPKDINVKWK IDGSERQNGVLNSWTDQDSKDSTYSMSSTLTLTKDEYERHN SYTCEATHKTSTSPIVKSFNRNEC |
| SEQ ID NO: 112 | AF002645_Pep2 | DIQMTQSPSSLSASVGDRVTITCRASQSISNRLAWYQQKPGK APKLLIYKASSLESGVPSRFSGSGSGTDFTLTISSLQPEDFATY YCQQSNSTPFTFGQGTKVEIKRADAAPTVSIFPPSSEQLTSGG ASVVCFLNNFYPKDINVKWKIDGSERQNGVLNSWTDQDSK DSTYSMSSTLTLTKDEYERHNSYTCEATHKTSTSPIVKSFNR NEC |

TABLE 16-continued

Sequences of Peptides in TABLE 15

| SEQ ID NO: | DBA | Sequence |
|---|---|---|
| SEQ ID NO: 114 | AF003229_Pep3 | DIQMTQSPSSLSASVGDRVTITCRASQYISSGLAWYQQKPGK APKLLIYKASSLDNGVPSRFSGSGSGTDFTLTISSLQPEDFAT YYCQQYERLPLTFGGGTKVEIKRADAAPTVSIFPPSSEQLTS GGASVVCFLNNFYPKDINVKWKIDGSERQNGVLNSWTDQD SKDSTYSMSSTLTLTKDEYERHNSYTCEATHKTSTSPIVKSF NRNEC |
| SEQ ID NO: 115 | AF003230_Pep3 | DIQMTQSPSSLSASVGDRVTITCRASQSIGTGLAWYQQKPGK APKLLIYKASSLDNGVPSRFSGSGSGTDFTLTISSLQPEDFAT YYCQQYNRAPLTFGGGTKVEIKRADAAPTVSIFPPSSEQLTS GGASVVCFLNNFYPKDINVKWKIDGSERQNGVLNSWTDQD SKDSTYSMSSTLTLTKDEYERHNSYTCEATHKTSTSPIVKSF NRNEC |
| SEQ ID NO: 116 | AF003232_Pep3 | DIQMTQSPSSLSASVGDRVTITCRASQSIGRWLAWYQQKPG KAPKLLIYSASNLETGVPSRFSGSGSGTDFTLTISSLQPEDFA TYYCQQYESFPVTFGPGTKVDIKRADAAPTVSIFPPSSEQLTS GGASVVCFLNNFYPKDINVKWKIDGSERQNGVLNSWTDQD SKDSTYSMSSTLTLTKDEYERHNSYTCEATHKTSTSPIVKSF NRNEC |
| SEQ ID NO: 126 | AF003219_Pep3 | DIQMTQSPSSLSASVGDRVTITCRASQSISSYLNWYQQKPGK APKLLIYAASSLESGVPSRFSGSGSGTDFTLTISSLQPEDFATY YCQQSYSTPYTFGQGTKVDIKRADAAPTVSIFPPSSEQLTSG GASVVCFLNNFYPKDINVKWKIDGSERQNGVLNSWTDQDS KDSTYSMSSTLTLTKDEYERHNSYTCEATHKTSTSPIVKSFN RNEC |

Example 7

Reduced Type I IFNα Reporter Activation by a PD-L1/IFNα Protein Complex

This example demonstrates reduced Type I IFNα reporter activation by a PD-L1/IFNα protein complex of the present disclosure, specifically a PD-L1/IFNα DBA/cytokine complexes, relative to unregulated antibody-IFNα immune cytokines. The DBA-cytokine protein complexes and control immune cytokines used in this experiment were IgG proteins with IFNα fused to the N-terminus of the heavy chain through a linker composed of 4 repeats of "GGGGS," as exemplified in FIG. 9E. The genes for two DBA-cytokine complexes, C08 IFNα

(CDLPQTHSLGSRRTLMLLAQMRRISLFSCLKDRHDFGFPQEEFGNQFQKAETIPVLHEM

IQQIFNLFSTKDSSAAWDETLLDKFYTELYQQLNDLEACVIQGVGVTETPLMKEDSILAV

RKYFQRITLYLKEKKYSPCAWEVVRAEIMRSFSLSTNLQESLRSKEGGGGSGGGGSGGG

GSGGGGSQVQLVQSGAEVKKPGASVKVSCKASGGTFSSYAISWVRQAPGQGLEWMGII

DPSVTYTRYAQKFQGRVTMTRDTSTSTVYMELSSLRSEDTAVYYCARSLFPTIFGVEVA

FDIWGQGTLVTVSSAKTTAPSVYPLAPVCGDTTGSSVTLGCLVKGYFPEPVTLTWNSGS

LSSGVHTFPAVLQSDLYTLSSSVTVTSSTWPSQSITCNVAHPASSTKVDKKIEPRGPTIKP

CPPCKCPAPNAAGGPSVFIFPPKIKDVLMISLSPIVTCVVVDVSEDDPDVQISWFVNNVE

VHTAQTQTHREDYNSTLRVVSALPIQHQDWMSGKEFKCKVNNKDLGAPIERTISKPKG

SVRAPQVYVLPPPEEEMTKKQVTLTCMVTDFMPEDIYVEWTNNGKTELNYKNTEPVLD

SDGSYFMYSKLRVEKKNWVERNSYSCSVVHEGLHNHHTTKSFSRTPGK SEQ ID NO: 57;

and

DIQMTQSPSSLSASVGDRVTITCQASQDISNYLNWYQQKPGKAPKLLIYGASTLQSGVPS

RFSGSGSGTDFTLTISSLQPEDFATYYCQQTYSTPITFGQGTKVEIKRADAAPTVSIFPPSS

-continued

EQLTSGGASVVCFLNNFYPKDINVKWKIDGSERQNGVLNSWTDQDSKDSTYSMSSTLT

LTKDEYERHNSYTCEATHKTSTSPIVKSFNRNEC; SEQ ID NO: 58)
and

B09 IFNα
(CDLPQTHSLGSRRTLMLLAQMRRISLFSCLKDRHDFGFPQEEFGNQFQKAETIPVLHEM

IQQIFNLFSTKDSSAAWDETLLDKFYTELYQQLNDLEACVIQGVGVTETPLMKEDSILAV

RKYFQRITLYLKEKKYSPCAWEVVRAEIMRSFSLSTNLQESLRSKEGGGGSGGGGSGGG

GSGGGGSQVQLVQSGAEVKKPGASVKVSCKASGGTFTGYYMHWVRQAPGQGLEWM

GWVNPNSGNTGYAQKFQGRVTMTRDTSTSTVYMELSSLRSEDTAVYYCARSLFPTIFG

VEVAFDIWGQGTLVTVSSAKTTAPSVYPLAPVCGDTTGSSVTLGCLVKGYFPEPVTLTW

NSGSLSSGVHTFPAVLQSDLYTLSSSVTVTSSTWPSQSITCNVAHPASSTKVDKKIEPRGP

TIKPCPPCKCPAPNAAGGPSVFIFPPKIKDVLMISLSPIVTCVVVDVSEDDPDVQISWFVN

NVEVHTAQTQTHREDYNSTLRVVSALPIQHQDWMSGKEFKCKVNNKDLGAPIERTISK

PKGSVRAPQVYVLPPPEEEMTKKQVTLTCMVTDFMPEDIYVEWTNNGKTELNYKNTEP

VLDSDGSYFMYSKLRVEKKNWVERNSYSCSVVHEGLHNHHTTKSFSRTPGK; SEQ ID

NO: 59
and

DIQMTQSPSSLSASVGDRVTITCQASQDISNYLNWYQQKPGKAPKLLIYAASSLQSGVPS

RFSGSGSGTDFTLTISSLQPEDFATYYCQQSYSPPPTFGQGTKLEIKRADAAPTVSIFPPSS

EQLTSGGASVVCFLNNFYPKDINVKWKIDGSERQNGVLNSWTDQDSKDSTYSMSSTLT

LTKDEYERHNSYTCEATHKTSTSPIVKSFNRNEC; SEQ ID NO: 60),
and two control immune-cytokines, anti-Her2 IFNα
(CDLPQTHSLGSRRTLMLLAQMRRISLFSCLKDRHDFGFPQEEFGNQFQKAETIPVLHEM

IQQIFNLFSTKDSSAAWDETLLDKFYTELYQQLNDLEACVIQGVGVTETPLMKEDSILAV

RKYFQRITLYLKEKKYSPCAWEVVRAEIMRSFSLSTNLQESLRSKEGGGGSGGGGSGGG

GSGGGGSQVQLVQSGAEVKKPGASVKVSCKASGGTFSSYAISWVRQAPGQGLEWMG

WINPNSGGTNYAQKFQGRVTMTRDTSTSTVYMELSSLRSEDTAVYYCARSLFPTIFGVE

VAFDIWGQGTTVTVSSAKTTAPSVYPLAPVCGDTTGSSVTLGCLVKGYFPEPVTLTWNS

GSLSSGVHTFPAVLQSDLYTLSSSVTVTSSTWPSQSITCNVAHPASSTKVDKKIEPRGPTI

KPCPPCKCPAPNAAGGPSVFIFPPKIKDVLMISLSPIVTCVVVDVSEDDPDVQISWFVNN

VEVHTAQTQTHREDYNSTLRVVSALPIQHQDWMSGKEFKCKVNNKDLGAPIERTISKP

KGSVRAPQVYVLPPPEEEMTKKQVTLTCMVTDFMPEDIYVEWTNNGKTELNYKNTEP

VLDSDGSYFMYSKLRVEKKNWVERNSYSCSVVHEGLHNHHTTKSFSRTPGK; SEQ ID

NO: 61
and

DIQMTQSPSSLSASVGDRVTITCRASQSIIDRLAWYQQKPGKAPKLLIYKASSLESGVPSR

FSGSGSGTDFTLTISSLQPEDFATYYCQQSYSTPFTFGPGTKVDIKRADAAPTVSIFPPSSE

QLTSGGASVVCFLNNFYPKDINVKWKIDGSERQNGVLNSWTDQDSKDSTYSMSSTLTL

TKDEYERHNSYTCEATHKTSTSPIVKSFNRNEC; SEQ ID NO: 62)
and anti-PD-L1 IFNα
(CDLPQTHSLGSRRTLMLLAQMRRISLFSCLKDRHDFGFPQEEFGNQFQKAETIPVLHEM

IQQIFNLFSTKDSSAAWDETLLDKFYTELYQQLNDLEACVIQGVGVTETPLMKEDSILAV

RKYFQRITLYLKEKKYSPCAWEVVRAEIMRSFSLSTNLQESLRSKEGGGGSGGGGSGGG

```
GSGGGGSEVQLVESGGGLVQPGGSLRLSCAASGFNIKDTYIHWVRQAPGKGLEWVARI

YPTNGYTRYADSVKGRFTISADTSKNTAYLQMNSLRAEDTAVYYCSRWGGDGFYAMD

YWGQGTLVTVSSAKTTAPSVYPLAPVCGDTTGSSVTLGCLVKGYFPEPVTLTWNSGSL

SSGVHTFPAVLQSDLYTLSSSVTVTSSTWPSQSITCNVAHPASSTKVDKKIEPRGPTIKPC

PPCKCPAPNAAGGPSVFIFPPKIKDVLMISLSPIVTCVVVDVSEDDPDVQISWFVNNVEV

HTAQTQTHREDYNSTLRVVSALPIQHQDWMSGKEFKCKVNNKDLGAPIERTISKPKGS

VRAPQVYVLPPPEEEMTKKQVTLTCMVTDFMPEDIYVEWTNNGKTELNYKNTEPVLDS

DGSYFMYSKLRVEKKNWVERNSYSCSVVHEGLHNHHTTKSFSRTPGK;  SEQ ID NO: 63
and

DIQMTQSPSSLSASVGDRVTITCRASQDVNTAVAWYQQKPGKAPKLLIYSASFLYSGVP

SRFSGSRSGTDFTLTISSLQPEDFATYYCQQHYTTPPTFGQGTKVEIKRADAAPTVSIFPPS

SEQLTSGGASVVCFLNNFYPKDINVKWKIDGSERQNGVLNSWTDQDSKDSTYSMSSTL

TLTKDEYERHNSYTCEATHKTSTSPIVKSFNRNEC;  SEQ ID NO: 64)
``` were synthesized, expressed in HEK293 cells and Protein A purified (GenScript). Titrated concentrations of the DBA-cytokine complexes and antibody-cytokine controls were added to a 96-well plate along with 50,000 type I IFNα reporter cells (InvivoGen) in complete DMEM (+10% FBS, 2 mM L-glutamine, sodium pyruvate). Plates were incubated at 37° C. overnight and developed by adding 20 uL of culture supernatant to 180 uL QUANTI-Blue Solution (InvivoGen). After a 30 minute incubation at room temperature, plates were read on an Envision (Perkin Elmer) at 630 nm. In the absence of PD-L1, the IFNα tethered PD-L1-IFNα DBA complexes C08 and B09 show decreased reporter activation compared to equimolar amounts of the control anti-PD-L1 or anti-HER2 IFNα immunocytokines (FIG. 10).

Example 8

Reduced CD8$^+$ T Cell STAT5 Phosphorylation by a PD-1/IL-2 Dual Binding Antibody (DBA) Cytokine Complexes This example describes CD8+ T-cell STAT5 phosphorylation by PD-1/IL-2 DBA-cytokine complexes of the present disclosure. Genes for the PD-1/IL-2 DBAs shown in TABLE 17 were synthesized and expressed in HEK293 as IgG proteins with IL-2 fused to the N-terminus of the heavy or light chain through a linker (Genscript). Although only two of the antibodies blocked IL-2 binding to IL-2RB as scFvs, over 30 of the antibodies were able to reduce IL-2 signaling by a linked IL-2 domain. An exemplary set of these DBAs were chosen for analysis and compared to a control anti-HER2-IL-2 immunocytokine (TABLE 17).

TABLE 17

IgG PD-1/IL-2 DBA protein complexes

| Name | Heavy Chain Sequence SEQ ID NO | Light Chain Sequence SEQ ID NO |
|---|---|---|
| Anti-HER2 | (SEQ ID NO: 65) EVQLVESGGGLVQPGGSLRLSCAA SGFNIKDTYIHWVRQAPGKGLEWV ARIYPTNGYTRYADSVKGRFTISAD TSKNTAYLQMNSLRAEDTAVYYCS RWGGDGFYAMDYWGQGTLVTVSS AKTTAPSVYPLAPVCGDTTGSSVTL GCLVKGYFPEPVTLTWNSGSLSSG VHTFPAVLQSDLYTLSSSVTVTSST WPSQSITCNVAHPASSTKVDKKIEP RGPTIKPCPPCKCPAPNAAGGPSVFI FPPKIKDVLMISLSPIVTCVVVDVSE DDPDVQISWFVNNVEVHTAQTQTH REDYNSTLRVVSALPIQHQDWMSG KEFKCKVNNKDLGAPIERTISKPKG SVRAPQVYVLPPPEEEMTKKQVTL TCMVTDFMPEDIYVEWTNNGKTEL NYKNTEPVLDSDGSYFMYSKLRVE KKNWVERNSYSCSVVHEGLHNHH TTKSFSRTPGK | (SEQ ID NO: 66) APTSSSTKKTQLQLEHLLLDLQ MILNGINNYKNPKLTRMLTFKF YMPKKATELKHLQCLEEELKPL EEVLNLAQSKNFHLRPRDLISNI NVIVLELKGSETTFMCEYADET ATIVEFLNRWITFCQSIISTLTVP GVGVPGAGVPGVGVPGGGVPG VGVPGGGVPGAGVPGGGVPGV GVPGAGVPGVGVPGGGDIQMT QSPSSLSASVGDRVTITCRASQD VNTAVAWYQQKPGKAPKLLIY SASFLYSGVPSRFSGSRSGTDFT LTISSLQPEDFATYYCQQHYTTP PTFGQGTKVEIKRADAAPTVSIF PPSSEQLTSGGASVVCFLNNFYP KDINVKWKIDGSERQNGVLNS WTDQDSKDSTYSMSSTLTLTKD EYERHNSYTCEATHKTSTSPIVK SFNRNEC |

TABLE 17-continued IgG PD-1/IL-2 DBA protein complexes

| Name | Heavy Chain Sequence SEQ ID NO | Light Chain Sequence SEQ ID NO |
|---|---|---|
| 2-A08 | (SEQ ID NO: 67)<br>QVQLVQSGAEVKKPGASVKVSCK<br>VSGYTFTSYDINWVRQAPGQGLEW<br>MGWINPNSGDTGYAQKFQGRVTM<br>TRDTSTSTVYMELSSLRSEDTAVYY<br>CARDTGLGYYYGSGDFDYWGQGT<br>LVTVSSAKTTAPSVYPLAPVCGDTT<br>GSSVTLGCLVKGYFPEPVTLTWNS<br>GSLSSGVHTFPAVLQSDLYTLSSSV<br>TVTSSTWPSQSITCNVAHPASSTKV<br>DKKIEPRGPTIKPCPPCKCPAPNAA<br>GGPSVFIFPPKIKDVLMISLSPIVTCV<br>VVDVSEDDPDVQISWFVNNVEVHT<br>AQTQTHREDYNSTLRVVSALPIQH<br>QDWMSGKEFKCKVNNKDLGAPIE<br>RTISKPKGSVRAPQVYVLPPPEEEM<br>TKKQVTLTCMVTDFMPEDIYVEWT<br>NNGKTELNYKNTEPVLDSDGSYFM<br>YSKLRVEKKNWVERNSYSCSVVHE<br>GLHNHHTTKSFSRTPGK | (SEQ ID NO: 68)<br>APTSSSTKKTQLQLEHLLLDLQ<br>MILNGINNYKNPKLTRMLTFKF<br>YMPKKATELKHLQCLEEEELKPL<br>EEVLNLAQSKNFHLRPRDLISNI<br>NVIVLELKGSETTFMCEYADET<br>ATIVEFLNRWITFCQSIISTLTVP<br>GVGVPGAGVPGVGVPGGGVPG<br>VGVPGGGVPGAGVPGGGVPGV<br>GVPGAGVPGVGVPGGGDIQMT<br>QSPSSLSASVGDRVTITCQASQD<br>IHNYLNWYQQKPGKAPKLLIYD<br>VSNLETGVPSRFSGSGSGTDFTL<br>TISSLQPEDFATYYCQQAISFPLT<br>FGGGTKVEIKRADAAPTVSIFPP<br>SSEQLTSGGASVVCFLNNFYPK<br>DINVKWKIDGSERQNGVLNSW<br>TDQDSKDSTYSMSSTLTLTKDE<br>YERHNSYTCEATHKTSTSPIVKS<br>FNRNEC |
| 2-A11 | (SEQ ID NO: 69)<br>QVQLVQSGAEVKKPGASVKVSCK<br>ASGHTFTRYYMHWVRQAPGQGLE<br>WMGIINPSGGYATYAQKFQGRVTM<br>TRDTSTSTVYMELSSLRSEDTAVYY<br>CASGWDVWGQGTLVTVSSAKTTA<br>PSVYPLAPVCGDTTGSSVTLGCLVK<br>GYFPEPVTLTWNSGSLSSGVHTFPA<br>VLQSDLYTLSSSVTVTSSTWPSQSIT<br>CNVAHPASSTKVDKKIEPRGPTIKP<br>CPPCKCPAPNAAGGPSVFIFPPKID<br>VLMISLSPIVTCVVVDVSEDDPDVQ<br>ISWFVNNVEVHTAQTQTHREDYNS<br>TLRVVSALPIQHQDWMSGKEFKCK<br>VNNKDLGAPIERTISKPKGSVRAPQ<br>VYVLPPPEEEMTKKQVTLTCMVTD<br>FMPEDIYVEWTNNGKTELNYKNTE<br>PVLDSDGSYFMYSKLRVEKKNWV<br>ERNSYSCSVVHEGLHNHHTTKSFSR<br>TPGK | (SEQ ID NO: 70)<br>APTSSSTKKTQLQLEHLLLDLQ<br>MILNGINNYKNPKLTRMLTFKF<br>YMPKKATELKHLQCLEEEELKPL<br>EEVLNLAQSKNFHLRPRDLISNI<br>NVIVLELKGSETTFMCEYADET<br>ATIVEFLNRWITFCQSIISTLTVP<br>GVGVPGAGVPGVGVPGGGVPG<br>VGVPGGGVPGAGVPGGGVPGV<br>GVPGAGVPGVGVPGGGDIQMT<br>QSPSSLSASVGDRVTITCRASQSI<br>NSWLAWYQQKPGKAPKLLIYA<br>TSTLESGVPSRFSGSGSGTDFTL<br>TISSLQPEDFATYYCQQSYSFPP<br>TFGQGTKVEIKRADAAPTVSIFP<br>PSSEQLTSGGASVVCFLNNFYPK<br>DINVKWKIDGSERQNGVLNSW<br>TDQDSKDSTYSMSSTLTLTKDE<br>YERHNSYTCEATHKTSTSPIVKS<br>FNRNEC |
| 2-B05 | (SEQ ID NO: 71)<br>QVQLVQSGAEVKKPGASVKVSCK<br>ASGYTFTNYYIHWVRQAPGQGLE<br>WMGIINPRAGYTSYALKFQGRVTM<br>TRDTSTSTVYMELSSLRSEDTAVYY<br>CAGGWLDWGQGTLVTVSSAKTTA<br>PSVYPLAPVCGDTTGSSVTLGCLVK<br>GYFPEPVTLTWNSGSLSSGVHTFPA<br>VLQSDLYTLSSSVTVTSSTWPSQSIT<br>CNVAHPASSTKVDKKIEPRGPTIKP<br>CPPCKCPAPNAAGGPSVFIFPPKID<br>VLMISLSPIVTCVVVDVSEDDPDVQ<br>ISWFVNNVEVHTAQTQTHREDYNS<br>TLRVVSALPIQHQDWMSGKEFKCK<br>VNNKDLGAPIERTISKPKGSVRAPQ<br>VYVLPPPEEEMTKKQVTLTCMVTD<br>FMPEDIYVEWTNNGKTELNYKNTE<br>PVLDSDGSYFMYSKLRVEKKNWV<br>ERNSYSCSVVHEGLHNHHTTKSFSR<br>TPGK | (SEQ ID NO: 72)<br>APTSSSTKKTQLQLEHLLLDLQ<br>MILNGINNYKNPKLTRMLTFKF<br>YMPKKATELKHLQCLEEEELKPL<br>EEVLNLAQSKNFHLRPRDLISNI<br>NVIVLELKGSETTFMCEYADET<br>ATIVEFLNRWITFCQSIISTLTVP<br>GVGVPGAGVPGVGVPGGGVPG<br>VGVPGGGVPGAGVPGGGVPGV<br>GVPGAGVPGVGVPGGGDIQMT<br>QSPSSLSASVGDRVTITCRASQSI<br>SSWLAWYQQKPGKAPKLLIYA<br>ASSLQSGVPSRFSGSGSGTDFTL<br>TISSLQPEDFATYYCQQSFTMPI<br>TFGQGTRLEIKRADAAPTVSIFP<br>PSSEQLTSGGASVVCFLNNFYPK<br>DINVKWKIDGSERQNGVLNSW<br>TDQDSKDSTYSMSSTLTLTKDE<br>YERHNSYTCEATHKTSTSPIVKS<br>FNRNEC |
| 2-B07 | (SEQ ID NO: 73)<br>QVQLVQSGAEVKKPGASVKVSCK<br>ASGDTFTRHYVHWVRQAPGQGLE<br>WMGIINPSGGYASYAQKFQGRVTM<br>TRDTSTSTVYMELSSLRSEDTAVYY<br>CAAGLFIWGQGTLVTVSSAKTTAPS<br>VYPLAPVCGDTTGSSVTLGCLVKG<br>YFPEPVTLTWNSGSLSSGVHTFPAV<br>LQSDLYTLSSSVTVTSSTWPSQSITC<br>NVAHPASSTKVDKKIEPRGPTIKPC<br>PPCKCPAPNAAGGPSVFIFPPKIKDV<br>LMISLSPIVTCVVVDVSEDDPDVQIS | (SEQ ID NO: 74)<br>APTSSSTKKTQLQLEHLLLDLQ<br>MILNGINNYKNPKLTRMLTFKF<br>YMPKKATELKHLQCLEEEELKPL<br>EEVLNLAQSKNFHLRPRDLISNI<br>NVIVLELKGSETTFMCEYADET<br>ATIVEFLNRWITFCQSIISTLTVP<br>GVGVPGAGVPGVGVPGGGVPG<br>VGVPGGGVPGAGVPGGGVPGV<br>GVPGAGVPGVGVPGGGDIQMT<br>QSPSSLSASVGDRVTITCRASQSI<br>GRWLAWYQQKPGKAPKLLIYS |

TABLE 17-continued

IgG PD-1/IL-2 DBA protein complexes

| Name | Heavy Chain Sequence SEQ ID NO | Light Chain Sequence SEQ ID NO |
|---|---|---|
|  | WFVNNVEVHTAQTQTHREDYNST<br>LRVVSALPIQHQDWMSGKEFKCKV<br>NNKDLGAPIERTISKPKGSVRAPQV<br>YVLPPPEEEMTKKQVTLTCMVTDF<br>MPEDIYVEWTNNGKTELNYKNTEP<br>VLDSDGSYFMYSKLRVEKKNWVE<br>RNSYSCSVVHEGLHNHHTTKSFSRT<br>PGK | ASNLETGVPSRFSGSGSGTDFTL<br>TISSLQPEDFATYYCQQANSFPV<br>TFGPGTKVDIKRADAAPTVSIFP<br>PSSEQLTSGGASVVCFLNNFYPK<br>DINVKWKIDGSERQNGVLNSW<br>TDQDSKDSTYSMSSTLTLTKDE<br>YERHNSYTCEATHKTSTSPIVKS<br>FNRNEC |
| 7-A04 | (SEQ ID NO: 75)<br>QVQLVQSGAEVKKPGASVKVSCK<br>ASGYTFTDYYMHWVRQAPGQGLE<br>WMGIINPRAGYTSYALKFQGRVTM<br>TRDTSTSTVYMELSSLRSEDTAVYY<br>CTSGMDVWGQGTLVTVSSAKTTAP<br>SVYPLAPVCGDTTGSSVTLGCLVK<br>GYFPEPVTLTWNSGSLSSGVHTFPA<br>VLQSDLYTLSSSVTVTSSTWPSQSIT<br>CNVAHPASSTKVDKKIEPRGPTIKP<br>CPPCKCPAPNAAGGPSVFIFPPKIKD<br>VLMISLSPIVTCVVVDVSEDDPDVQ<br>ISWFVNNVEVHTAQTQTHREDYNS<br>TLRVVSALPIQHQDWMSGKEFKCK<br>VNNKDLGAPIERTISKPKGSVRAPQ<br>VYVLPPPEEEMTKKQVTLTCMVTD<br>FMPEDIYVEWTNNGKTELNYKNTE<br>PVLDSDGSYFMYSKLRVEKKNWV<br>ERNSYSCSVVHEGLHNHHTTKSFSR<br>TPGK | (SEQ ID NO: 76)<br>APTSSSTKKTQLQLEHLLLDLQ<br>MILNGINNYKNPKLTRMLTFKF<br>YMPKKATELKHLQCLEEELKPL<br>EEVLNLAQSKNFHLRPRDLISNI<br>NVIVLELKGSETTFMCEYADET<br>ATIVEFLNRWITFCQSIISTLTVP<br>GVGVPGAGVPGVGVPGGGVPG<br>VGVPGGGVPGAGVPGGGVPGV<br>GVPGAGVPGVGVPGGGDIQMT<br>QSPSSLSASVGDRVTITCRASQSI<br>STWLAWYQQKPGKAPKLLIYA<br>ASSLQSGVPSRFSGSGSGTDFTL<br>TISSLQPEDFATYYCQQSYSFPV<br>TFGQGTKVEIKRADAAPTVSIFP<br>PSSEQLTSGGASVVCFLNNFYPK<br>DINVKWKIDGSERQNGVLNSW<br>TDQDSKDSTYSMSSTLTLTKDE<br>YERHNSYTCEATHKTSTSPIVKS<br>FNRNEC |

Figure 11:
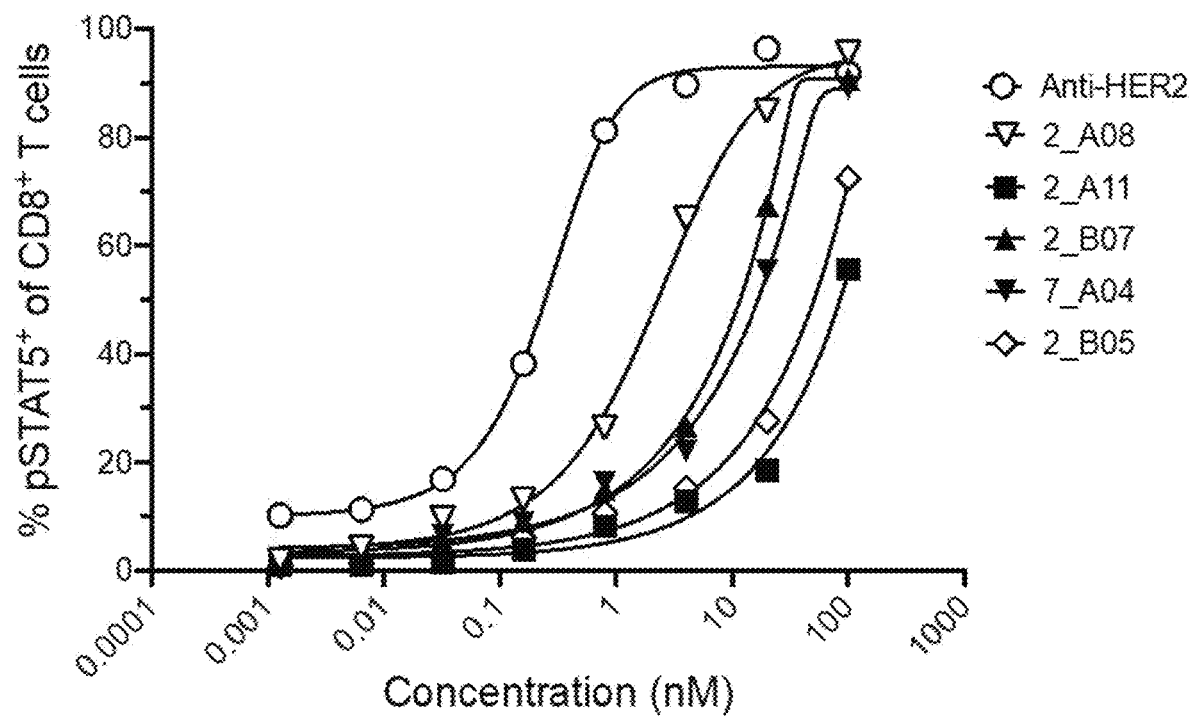
FIG. 11 shows that IL-2 signaling by five exemplary PD-1/IL-2 DBA-cytokine protein complexes (2_A08, 2_A11, 2_B05, 2_B07, and 7_A04, SEQ ID NO: 67-SEQ ID NO: 68, SEQ ID NO: 69-SEQ ID NO: 70, SEQ ID NO: 71-SEQ ID NO: 72, SEQ ID NO: 73-SEQ ID NO: 74 and SEQ ID NO: 75-SEQ ID NO: 76 respectively) is reduced as compared to a control IL-2-Anti-HER2 protein complex (SEQ ID NO: 65-SEQ ID NO: 66).

The PD-1/IL-2 DBA-cytokine complexes were serially diluted in complete RPMI (+1000 FBS, 2 mM L-glutamine, sodium pyruvate) and added to a 96-well plate. $2 \times 10^5$ human PBMCs were added to each well and plates were incubated at 37° C. for 20 minutes. An equal volume prewarmed fixation buffer (Biolegend) was then added to each well and plates were incubated at 37° C. for 10 minutes. Cells were then fixed in pre-chilled Perm Buffer III (BD Biosciences) for 30 minutes at 4'° C. Cells were washed with FACS wash buffer (PBS+2% FBS, 2 mM EDTA) and stained with fluorophore labeled antibodies directed against CD3, CD4, CD8, (BioLegend) and phospho-STAT5 (BD Biosciences) diluted 1:20 in FACS wash buffer. Cells were incubated 1 hour at 4° C., washed with FACS wash buffer, and analyzed on a SA3800 Spectral Analyzer. In the absence of PD-1, the PD-1/IL-2 DBA/cytokine complexes induced less STAT5 phosphorylation in T cells compared to the monospecific control anti-HER2 IL-2 immunocytokine (FIG. 11).

Example 9

Figure 12:
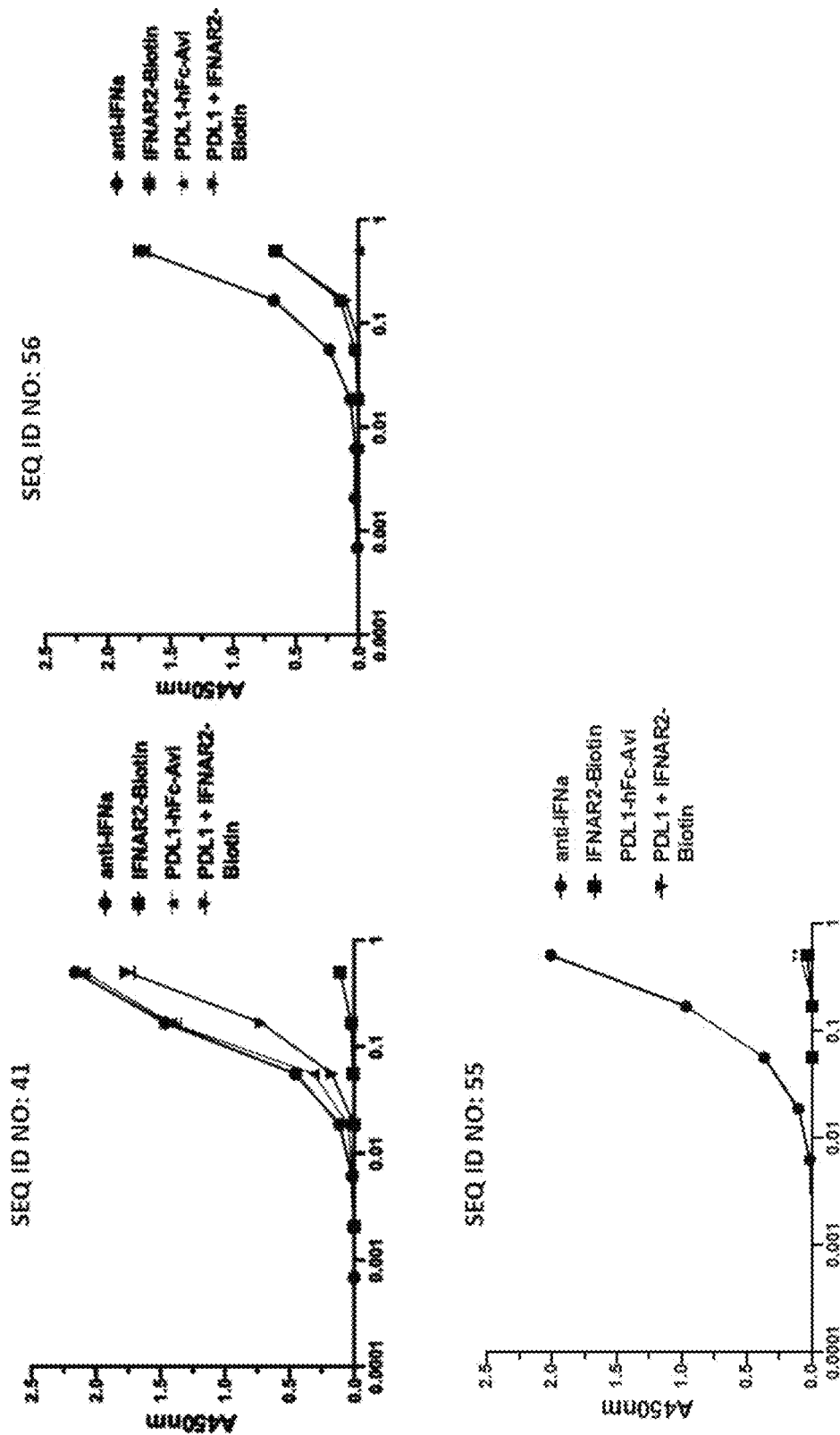
FIG. 12 shows PD-L1 regulated IFNα activity of an exemplary PD-L1/IFNα DBA-cytokine protein complex.

Regulated Interferon Receptor Binding by a PD-L1/IFNα Dual Binding Antibody (DBA) Cytokine Complex This example describes regulated interferon receptor binding by a PD-L1/IFNα DBA-cytokine complex. DBA-cytokine complexes of SEQ ID NO: 41 and SEQ ID NO: 55 (MSTSTCDLPQTHSLGSRRTLMLLAQMRRISLF-SCLKDRHDFGFPQEEFGNQFQKAETIP VLHEMIQQIFNLFSTKDSSAAWDETLLDKFYTE-LYQQLNDLEACVIQGVGVTETPLMKE DSI-LAVRKYFQRITLYLKEKKYSPCAWEVVRAE-IMRSFSLSTNLQESLRSKEGGGGSGG GGSGGGGSGGGGSQVQLVQSGAEVKKP-GASVKVSCKASGNTFTDYYMHWVRQAPGQ GLEWMGWMNPNSGNTGYAQKFQGRVTMTRDTST-STVYMELSSLRSEDTAVYYCARS LFP-TIFGVEVAFDIWGQGTLVTVSSAS-GGGGSGGGGSGGGGSHASDIQMTQSPSSLSAS VGDRVTITCQASQDISNYLNWYQQKPGKAPKLLI-YAASSLESGVPSRFSGSGSGTDFTLT ISSLQPEDFA-TYYCQQSYSTPPTFGQGTRLEIKGKPIPNPLLGLDST) were chosen for analysis with a negative control with a similar structure based on a HER2 binding scFv (SEQ ID NO: 56, MSTSTCDLPQTHSLGSRRTLMLLAQMRRIS-LFSCLKDRHDFGFPQEEFGNQFQKAETIPV LHEMIQQIFNLFSTKDSSAAWDETLLDKFYTE-LYQQLNDLEACVIQGVGVTETPLMKED SILAVRKYFQRITLYLKEKKYSPCAWEVVRAE-IMRSFSL STNLQESLRSKEGGGGSGGG GSGGGGSGGGGSEVQLVESGGGLVQPGGSLRLS-CAASGFNIKDTYIHWVRQAPGKGLE WVARIYPTNGYTRYADSVKGRFTISADTSKNTAY-LQMNSLRAEDTAVYYCSRWGGDG FYAMDYWGQGTLVTVSSASGGGGSGGGGSGGGG-SHASDIQMTQSPSSLSASVGDRVTI TCRASQDVNTA-VAWYQQKPGKAPKLLIYSASFLY-SGVPSRFSGSRSGTDFTLTISSLQPE DFATYYCQQHYTTPPTFGQGTKVEIKGKPIPN-PLLGLDST). The proteins were expressed using a cell-free transcription/translation system (Cosmo Bio USA, Inc., PUREfrex2.1, Product #GFK-PF213 with DS Supplement, Prod. #GFK-PF005). 96-well ELISA plates were coated with anti-V5 antibody (SV5-pk1) at 50 ng/well overnight at 4° C. The plates were washed twice by adding 200 ul/well of SuperBlock with 0.05% Tween 20 (SBT), and the final SBT wash was incubated for 15 min at room temperature before aspiration. A dilution series of the protein for each construct in SBT was then added to the anti-V5-coated plates at 50 μl/well and incubated for 1 hour at room temperature. Each plate was then washed three times with PBS with 0.05% Tween 20 (PBST). Bound constructs were then probed with either anti-IFNα, IFNAR2-Biotin, PDL1-hFc-Avi or the combination of IFNAR2-Biotin and PDL1-hFc-Avi in SBT at 50 ul/well for 1 hour at room temperature. Plates were washed 3× with PBST. Goat anti-mIgG-TRP or Streptavidin-TRP was added at 50 ul/well and incubated for 30 min at room temperature followed by 3× wash with PBST. Plates were developed by adding 50 ul/well of TMB and the reaction was terminated with an equal volume of ELISA stop solution. As shown in FIG. 12 (top left), IFNAR2 binding to the DBA-IFNα complex (SEQ ID NO: 41) increased in a dose dependent manner with the addition of PD-L1. IFNAR2 binding to a control HER2-specific antibody-IFNα complex (SEQ ID NO: 56) was unaffected by the addition of PD-L1 (FIG. 12 top right). IFNAR2 binding to a DBA-IFNα complex containing SEQ ID NO: 55, was not affected by addition of PD-L1 at these concentrations (FIG. 12 bottom). The protein complex of SEQ ID NO: 55 is similar to the protein complex of SEQ ID NO: 41, except that the sensor domain of SEQ ID NO: 55 has a higher affinity for IFNα than the sensor domain of SEQ ID NO: 41. Protein complexes of the present invention may need the correct balance between their affinity for the marker and their affinity for the therapeutic domain.

Example 10

PD-L1/IFNα Protein Complexes for PD-L1 Dependent IFNα Activity In Vitro

This example describes PD-L1/IFNα protein complexes for PD-L1 dependent IFNα activity in vitro. PD-L1/IFNα protein complexes comprise a DBA capable of binding PD-L1 marker and an IFNα therapeutic domain where the protein complex is linked to the IFNα therapeutic cytokine via a linker. In the absence of PD-L1, the PD-L1 sensor domain binds the IFNα therapeutic domain, rendering the IFNα therapeutic inert. In the presence of PD-L1 (e.g., PD-L1 is expressed on a cell, such as a tumor cell or immune cell), the PD-L1 sensor domain binds PD-L1, thereby unbinding the IFNα therapeutic domain and allowing for IFNα to exhibit therapeutic activity.

PD-L1/IFNα protein complexes are designed and recombinantly expressed or chemically synthesized. PD-L1/IFNα protein complexes are administered in vitro to a cell (e.g., in cell culture). In the absence of the PD-L1 marker, the IFNα domain remains bound to the PD-L1 sensor domain and no therapeutic effect is observed. The cell may express PD-L1 endogenously or after activation, or following introduction of a gene encoding PD-L1. If the cell is a tumor cell expressing a PD-L1 marker, the therapeutic effect may be inhibition of cell growth or induction of IFNα-responsive genes. Where the cell is an immune cell, the therapeutic effect may be cell growth, activation or induction of IFN-responsive genes. Where the cell is part of a mixture of cell types, any of these changes may be monitored for a responding cell population in the mixture.

Example 11

PD-L1 Dependent IFNα Activity In Vivo

This example describes PD-L1/IFNα protein complexes for PD-L1 dependent IFNα activity in vivo. PD-L1/IFNα protein complexes comprise a PD-L1 sensor domain (e.g., an anti-PD-L1 antibody or an anti-PD-L1 scFv) linked to an IFNα cytokine via a linker, where the IFNα cytokine is a therapeutic. In the absence of PD-L1, the PD-L1 sensor domain binds the IFNα therapeutic domain, rendering the IFNα therapeutic inert. In the presence of PD-L1 (e.g., PD-L1 is expressed on a cell, such as a tumor cell or immune cell), the PD-L1 sensor domain binds PD-L1, thereby unbinding the IFNα therapeutic domain and allowing for IFNα to exhibit therapeutic activity.

PD-L1/IFNα protein complexes are recombinantly expressed or chemically synthesized. PD-L1/IFNα protein complexes are administered in vivo to a subject in need thereof. Administration is performed intravenously, intramuscularly, subcutaneously, intradermally, intraperitoneally, or mucosally. In the absence of PD-L1, the IFNα therapeutic domain remains bound to the PD-L1 sensor domain and no therapeutic efficacy is observed (e.g., cell proliferation in the subject is uninhibited). In the presence of PD-L1, the PD-L1 sensor domain binds PD-L1 and unbinds the IFNα therapeutic domain. Therapeutic efficacy is observed (e.g., cell proliferation is inhibited or immune cell activation occurs). The cell is a tumor cell expressing PD-L1. The subject is a human or non-human animal in need thereof. The subject has a disease. The disease is cancer.

Example 12

PD-1 Dependent IL-2 Activity In Human Cells

This example describes PD-1/IL-2 protein complexes for PD-1 dependent IL-2 activity in human cells, in vitro and in vivo. PD-1/IL-2 protein complexes comprise a PD-1 sensor domain (e.g., an anti-PD-1 antibody or an anti-PD-1 scFv) linked to an IL-2 cytokine therapeutic domain via a linker, where the IL-2 cytokine is a therapeutic. In the absence of PD-1, the PD-1 sensor domain binds the IL-2 therapeutic domain, rendering the IL-2 therapeutic inert. In the presence of PD-1 (e.g., PD-1 is expressed on a cell, such as an immune cell), the PD-1 sensor domain binds PD-1, thereby unbinding the IL-2 therapeutic domain and allowing for IL-2 to exhibit therapeutic activity.

PD-1/IL-2 protein complexes are recombinantly expressed or chemically synthesized. PD-1/IL-2 protein complexes are administered in vitro to a human cell or in vivo to a mouse or to a human subject in need thereof. The human cell is a cell expressing PD-1. Administration to a mouse or to a human subject is performed intravenously, intramuscularly, subcutaneously, intradermally, intraperitoneally, or mucosally. In the absence of PD-1, the IL-2 therapeutic domain remains bound to the PD-1 sensor domain and no therapeutic efficacy is observed (e.g., cell activation in vitro and in the subject is unaltered). In the presence of PD-1, the PD-1 sensor domain binds PD-1 and unbinds the IL-2 therapeutic domain. Therapeutic efficacy is observed (e.g., cell activation is observed in vitro and, in the subject, in vivo). The subject has a disease. The disease is cancer. The cell may express PD-1 endogenously or after activation, or following introduction of a gene encoding PD-1. The therapeutic effect may be cell growth, differentiation, activation or induction of IL2-responsive genes. In vitro, if the cell is part of a mixture of cell types, any of these changes may be monitored for a responding cell population in the mixture.

Example 13

Bioactivity in Tumor Tissues

This example describes bioactivity in tumor tissues. A protein complex of the present disclosure is recombinantly expressed or chemically synthesized. The protein complex includes a sensor domain linked to a therapeutic domain. The linker is a peptide linker. The sensor domain is capable of binding to the therapeutic and a marker. In the absence if the marker, the sensor domain binds the therapeutic domain, rendering the therapeutic domain unable to bind to its target and unable to exert therapeutic activity. In the presence of the marker, the sensor domain binds the marker rendering the therapeutic domain free to bind to its target and able to exert therapeutic activity. The protein complex is administered in vitro to a cell or in vivo to a subject in need thereof. The cell expresses the marker to which the sensor domain binds. The cell is a tumor cell or immune cell. The subject is a human or non-human animal. The subject has a disease. The disease is cancer. Administration to a subject is performed intravenously, intramuscularly, subcutaneously, intradermally, intraperitoneally, or mucosally.

Upon administration of the protein-complex, the sensor domain binds the marker in vitro or in vivo in the subject and unbinds the therapeutic domain. Therapeutic efficacy is observed in vitro or in vivo in the subject, for example, cell proliferation of tumor cells is slowed down or completely halted and tumor cells are eliminated.

Example 14

Activity in Tumor Models of Protein Complexes

This example describes activity in tumor models. The tumor models assess the efficacy and systemic on-target effects of the protein complexes. The tumor model assesses the ability of a protein complex of the present disclosure to exhibit sensor domain regulated activity of the therapeutic domain.

A protein complex of the present disclosure is recombinantly expressed or chemically synthesized. The protein complex includes a sensor domain linked to a therapeutic domain. The linker is a peptide linker. The sensor domain is capable of binding to the therapeutic domain and a marker. In the absence of the marker, the sensor domain binds the therapeutic domain rendering the therapeutic domain unable to bind to its target and unable to exert therapeutic activity. In the presence of the marker, the sensor domain binds the marker rendering the therapeutic domain free to bind to its target and able to exert therapeutic activity. The protein complex is administered in a tumor model, in vitro or in vivo. The tumor cells or the immune cells in the tumor model express the marker to which the sensor domain binds. Administration in vivo is performed intravenously, intramuscularly, subcutaneously, intradermally, intraperitoneally, or mucosally.

Tumor measurement. Prior to administration of the protein-complex, or in a control sample where the protein-complex is not administered, measurements of the tumor indicate that the tumor is continuing to proliferate. For example, a solid tumor in a tumor model (e.g., a mouse model of a tumor) is measured using calipers. Prior to administration of the protein-complex, or in a control sample where the protein-complex is not administered, the solid tumor continues to grow in size, as indicated by increasing measurements of tumor size with calipers. Upon administration of the protein-complex, over time, the sensor domain binds the marker expressed on the tumor and the therapeutic domain is unbound, thus, resulting in therapeutic efficacy. Therapeutic efficacy is validated by observing decreasing measurements of tumor size with calipers over time.

Immune activation. Prior to administration of the protein-complex, or in a control sample where the protein-complex is not administered, the solid tumor continues to grow in size, as indicated by increasing measurements of tumor size with calipers. Upon administration of the protein-complex, over time, the sensor domain binds the marker and the therapeutic domain is unbound, thus, resulting in therapeutic efficacy. Therapeutic efficacy is validated by observing differences in the immune cells in the tumor, lymph node or systemically, when compared to the control sample. The differences may be immune cell phenotypes, activation state, differentiation state or specificity.

Systemic induction of cytokine markers. No induction of cytokine markers or reduced systemic induction of cytokine markers, when compared to the control, is observed upon administration of the protein complex.

Weight loss. No weight loss or reduced weight loss, when compared to the control, is observed upon administration of the protein complex.

Example 15

PD-1/IL-2 DBA Cytokine Complex Induction of STAT5 Phosphorylation in a Lymphocyte Cell Line This example describes PD-1/IL-2 DBA-cytokine complex induction of STAT5 phosphorylation in a lymphocytic cell line. To assess the dependence of PD-1/IL-2 DBA-cytokine complex activity on binding to PD-1, a PD-1-expressing variant is generated of an IL-2R+ T cell line such as Hut78 or Jurkat E6.1. The PD-1+ and PD-1− variant cell lines are treated with titrating concentrations of a PD-1/IL-2 DBA-cytokine complex of this disclosure, and STAT5 phosphorylation is assessed by phospho-flow, TR-FRET, or other assays for measuring IL-2 signaling.

A HEK 293 IL-2 reporter cell line is engineered to express PD-1. The PD-1+ and PD-1-variant cell lines are treated with titrating concentrations of PD-1/IL-2 DBA-cytokine complexes, and reporter activity is assessed as a measurement of IL-2 signaling. The PD-1/IL-2 DBA-cytokine complex exhibits increased potency on PD-1+ variant cell lines.

Example 16

PD-1/IL-2 DBA Cytokine Complex Induction of STAT5 Phosphorylation and Other Markers of Activation, and Proliferation in Primary Lymphocytes This example describes PD-1/IL-2 DBA-cytokine complex induction of STAT5 phosphorylation and other markers of activation and proliferation in primary lymphocytes. PBMCs are labeled with cell proliferation dye and incubated for 4 days with titrating concentrations of a PD-1/IL-2 DBA-cytokine complex of the present disclosure. PBMCs are stained with antibodies directed against immune cell phenotyping markers to distinguish CD4+ and CD8+ T cells, Treg cells, and natural killer (NK) cells and markers of cell activation, such as CD25. Dye dilution on immune cell subsets is examined by flow cytometry as a measurement of proliferation.

Total T cells are isolated from PBMCs using immunomagnetic negative selection (STEMCELL) and stimulated with plate-bound anti-CD3 and soluble anti-CD28 for 72 hours to induce expression of PD-1. The PD-1+ T cells are incubated for 20 minutes with titrating concentrations of PD-1/IL-2 DBA-cytokine complexes. STAT5 phosphorylation is measured in fixed and permeabilized T cells by flow cytometry. In some experiments, PD-1 may be blocked on T cells with anti-PD-1 prior to treatment with PD-1/IL-2 DBA-cytokine complexes to assess the dependence of PD-1/IL-2 DBA-cytokine complex activity on binding to PD-1. The PD-1/IL-2 DBA-cytokine complex induces minimal STAT5 phosphorylation when PD-1 is blocked, showing activity that is conditional on its ability to bind PD-1.

Example 17

In Vivo PD-1/IL-2 DBA Cytokine Complex Signaling in Non-Tumor Peripheral Tissues This example describes PD-1/IL-2 DBA-cytokine complex pharmacokinetics in the blood of wild-type mice and the signaling of the complex in non-tumor peripheral tissue. The serum half-lives and peripheral tissue activities of PD-1/IL-2 DBA-cytokine complexes and suitable non-regulated controls such as anti-PD-1, anti-HER2-IL-2, or anti-PD-1-IL-2 were measured in mice dosed intravenously (i.v.) with the complexes. Blood, spleens, or both were collected at various timepoints after treatment and stained to identify CD8+ T cells and NK cells.

Figure 18:
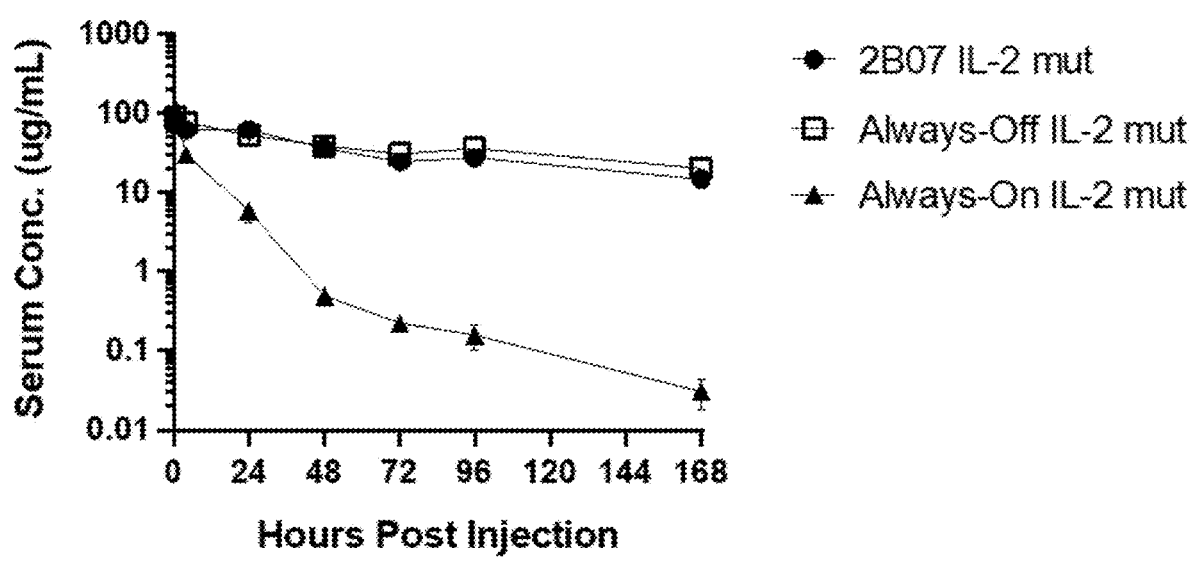
FIG. 18 provides rates of serum concentration decreases in the blood of wild-type mice of a PD-1/IL-2 DBA-cytokine complex ('2B07 IL-2 mut') and two control complexes.
Figure 19A:
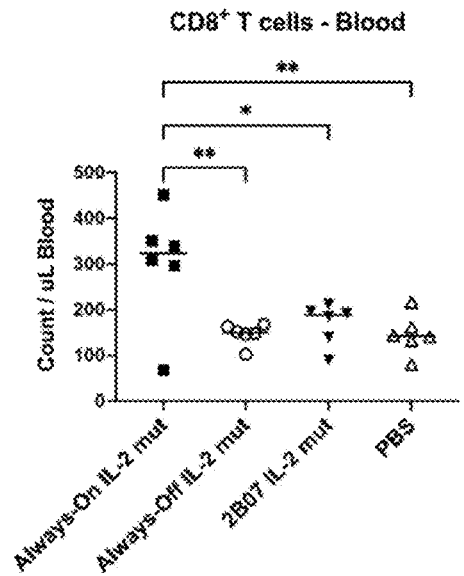
FIG. 19A-D provide CD8+ T cell and NK cell counts in blood and spleen tissue collected from wild-type mice 5 days following treatment with a PD-1/IL-2 DBA-cytokine complex ('2B07 IL-2 mut') and two control complexes.
Figure 19B:
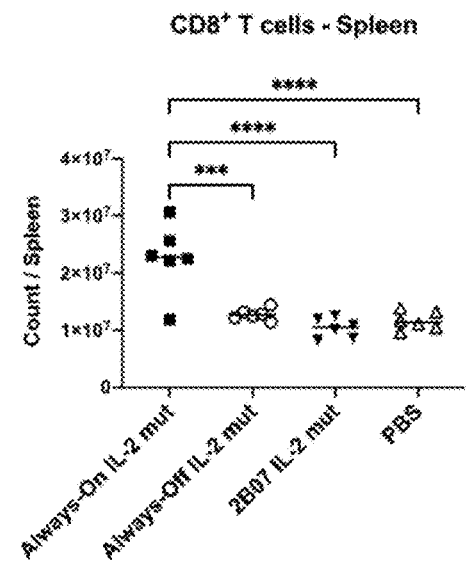
Figure 19C:
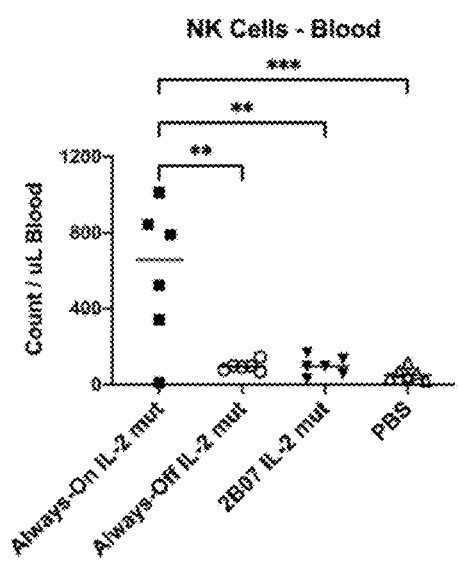
Figure 19D:
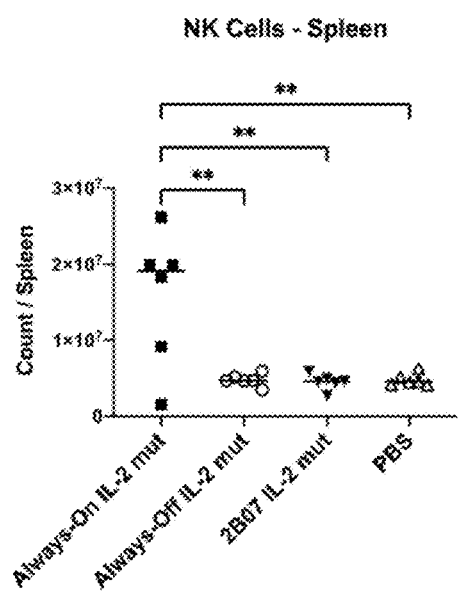

To examine the half-life of PD-1/IL-2 DBA-cytokine complex in circulation, wild-type C57BL/6 mice received a single 2.5 milligrams per kilogram intravenous dose of a PD-1/IL-2 DBA-cytokine complex (2B07 IL-2 mut; SEQ ID NO: 205-206), anti-HER2/IL-2-cytokine complex (Always-on IL-2 mut; SEQ ID NO: 64 and SEQ ID NO: 207), or anti-IL-2/IL-2-cytokine complex (Always-off IL-2 mut; SEQ ID SEQ ID NO: 208-209), as outlined in TABLE 20. Mice were bled via retro-orbital sinus at 30 minutes, 4, 24, 48, 72, 96, and 168 hours post-dosing. The blood was collected into serum separator tubes, and the isolated serum was frozen at −80° C. until analysis. To determine serum levels of the cytokine complexes, 96-well high-binding ELISA plates were coated with 1 ug/mL rabbit anti-hu IL-2 capture antibody (clone ab9618, Abcam) in carbonate-bicarbonate buffer overnight at 4 C. Plates were washed three times and blocked for 1 hour with SuperBlock blocking buffer (Thermo Scientific). Serum samples from the various timepoints and treatment groups were diluted in SuperBlock, added to the plates, and incubated 1 hr. To detect cytokine complexes, plates were incubated with goat anti-mouse Fc-HRP (Jackson ImmunoResearch) at 1:5000 in SuperBlock for 1 hour. The plates were then washed and developed with TMB substrate. Absorbance (GD) was measured using an EnVision 2105 microplate reader (PerkinElmer) at 450 nm. As shown in FIG. 18, at all timepoints examined the PD-1/IL-2 DBA-cytokine complex was detected at similar serum concentrations as the anti-IL-2/IL-2-cytokine complex. In contrast, the serum concentration of the non-regulated anti-HER2/IL-2-cytokine complex showed a greater decrease in serum concentration over time.

TABLE 20

| IgG PD-1/IL-2 DBA and control protein complexes | | |
|---|---|---|
| Protein Complexes | SEQ ID NO: | Sequence |
| 2B07 IL-2 mut | SEQ ID NO: 205 | APASSSTKKTQLQLEHLLLDLQMILNGINNYKNPKLTRMLTAKFAMPKKATELKHL QCLEEELKPLEEVLNGAQSKNFHLRPRDLISNINVIVLELKGSETTFMCEYADETATIV EFLNRWITFAQSIISTLTGGGGSGGGGSGGGGSGGGGSQVQLVQSGAEVKKPGAS VKVSCKASGDTFTRHYVHWVRQAPGQGLEWMGIINPSGGYASYAQKFQGRVTM TRDTSTSTVYMELSSLRSEDTAVYYCAAGLFIWGQGTLVTVSSAKTTAPSVYPLAPV CGDTTGSSVTLGCLVKGYFPEPVTLTWNSGSLSSGVHTFPAVLQSDLYTLSSSVTVT SSTWPSQSITCNVAHPASSTKVDKKIEPRGPTIKPCPPCKCPAPNAAGGPSVFIFPPK IKDVLMISLSPIVTCVVVDVSEDDPDVQISWFVNNVEVHTAQTQTHREDYNSTLRV VSALPIQHQDWMSGKEFKCKVNNKDLGAPIERTISKPKGSVRAPQVYVLPPPEEE MTKKQVTLTCMVTDFMPEDIYVEWTNNGKTELNYKNTEPVLDSDGSYFMYSKLR VEKKNWVERNSYSCSVVHEGLHNHHTTKSFSRTPGK |
| | SEQ ID NO: 206 | DIQMTQSPSSLSASVGDRVTITCRASQSIGRWLAWYQQKPGKAPKLLIYSASNLET GVPSRFSGSGSGTDFTLTISSLQPEDFATYYCQQYESFPVTFGPGTKVDIKRADAAPT VSIFPPSSEQLTSGGASVVCFLNNFYPKDINVKWKIDGSERQNGVLNSWTDQDSK DSTYSMSSTLTLTKDEYERHNSYTCEATHKTSTSPIVKSFNRNEC |
| anti-HER2/IL-2-cytokine complex | SEQ ID NO: 64 | DIQMTQSPSSLSASVGDRVTITCRASQDVNTAVAWYQQKPGKAPKLLIYSASFLYS GVPSRFSGSRSGTDFTLTISSLQPEDFATYYCQQHYTTPPTFGQGTKVEIKRADAAP TVSIFPPSSEQLTSGGASVVCFLNNFYPKDINVKWKIDGSERQNGVLNSWTDQDSK DSTYSMSSTLTLTKDEYERHNSYTCEATHKTSTSPIVKSFNRNEC |
| | SEQ ID NO: 207 | APASSSTKKTQLQLEHLLLDLQMILNGINNYKNPKLTRMLTAKFAMPKKATELKHL QCLEEELKPLEEVLNGAQSKNFHLRPRDLISNINVIVLELKGSETTFMCEYADETATIV EFLNRWITFAQSIISTLTGGGGSGGGGSGGGGSGGGGSEVQLVESGGGLVQPGGS LRLSCAASGFNIKDTYIHWVRQAPGKGLEWVARIYPTNGYTRYADSVKGRFTISAD TSKNTAYLQMNSLRAEDTAVYYCSRWGGDGFYAMDYWGQGTLVTVSSAKTTAP SVYPLAPVCGDTTGSSVTLGCLVKGYFPEPVTLTWNSGSLSSGVHTFPAVLQSDLYT LSSSVTVTSSTWPSQSITCNVAHPASSTKVDKKIEPRGPTIKPCPPCKCPAPNAAGG PSVFIFPPKIKDVLMISLSPIVTCVVVDVSEDDPDVQISWFVNNVEVHTAQTQTHRE DYNSTLRVVSALPIQHQDWMSGKEFKCKVNNKDLGAPIERTISKPKGSVRAPQVY VLPPPEEEMTKKQVTLTCMVTDFMPEDIYVEWTNNGKTELNYKNTEPVLDSDGSY FMYSKLRVEKKNWVERNSYSCSVVHEGLHNHHTTKSFSRTPGK |
| Always-off IL-2 mut | SEQ ID NO: 208 | APASSSTKKTQLQLEHLLLDLQMILNGINNYKNPKLTRMLTAKFAMPKKATELKHL QCLEEELKPLEEVLNGAQSKNFHLRPRDLISNINVIVLELKGSETTFMCEYADETATIV EFLNRWITFAQSIISTLTGGGGSGGGGSGGGGSGGGGSEVQLVESGGGLVKPGGS LRLSCAASGFTFSSYTLAWVRQAPGKGLEWVAAIDSSSYTYSPDTVRGRFTISRDNA KNSLYLQMNSLRAEDTAVYYCARDSNWDALDYWGQGTLVTVSSAKTTAPSVYPL APVCGDTTGSSVTLGCLVKGYFPEPVTLTWNSGSLSSGVHTFPAVLQSDLYTLSSSV TVTSSTWPSQSITCNVAHPASSTKVDKKIEPRGPTIKPCPPCKCPAPNAAGGPSVFIF |

TABLE 20-continued

IgG PD-1/IL-2 DBA and control protein complexes

| Protein Complexes | SEQ ID NO: | Sequence |
|---|---|---|
| | | PPKIKDVLMISLSPIVTCVVVDVSEDDPDVQISWFVNNVEVHTAQTQTHREDYNST LRVVSALPIQHQDWMSGKEFKCKVNNKDLGAPIERTISKPKGSVRAPQVYVLPPPE EEMTKKQVTLTCMVTDFMPEDIYVEWTNNGKTELNYKNTEPVLDSDGSYFMYSKL RVEKKNWVERNSYSCSVVHEGLHNHHTTKSFSRTPGK |
| | SEQ ID NO: 209 | DIQMTQSPSSLSASVGDRVSITCKASQNVGTNVGWYQQKPGKAPKALIYSASFRYS GVPSRFSGSGSGTDFTLTISSLQPEDFATYFCQQYYTYPYTFGGGTKLEIKRADAAPT VSIFPPSSEQLTSGGASVVCFLNNFYPKDINVKWKIDGSERQNGVLNSWTDQDSK DSTYSMSSTLTLTKDEYERHNSYTCEATHKTSTSPIVKSFNRNEC |

To examine the activity of PD-1/IL-2 DBA-cytokine complexes in peripheral tissues, wild-type C57BL/6 mice received a single 2.5 milligrams per kilogram intravenous dose of PD-1/IL-2 DBA-cytokine complex (2B07 IL-2 mut; SEQ ID NO: 205-206), anti-HER2/IL-2-cytokine complex (Always-on IL-2 mut; SEQ ID NO: 64 and SEQ ID NO: 207), anti-IL-2/IL-2-cytokine complex (Always-off IL-2 mut; SEQ ID NO: 208-209), as shown in TABLE 20 or PBS. Prior to dosing, the presence of intact IL-2 within each IL-2 cytokine complex was confirmed by ELISA as a means of verifying their potential for biological activity. Blood and spleens were collected 5 days following treatment and analyzed by flow cytometry to quantify the number of CD8+ T cells and NK cells per spleen and per microliter of blood. The PD-1/IL-2 DBA-cytokine complex did not induce expansion of CD8 T cells or NK cells, whereas the HER2/IL-2-cytokine complex induced expansion of peripheral CD8+ T cells and NK cells (FIG. 19A-D).

Example 18

Figure 20:
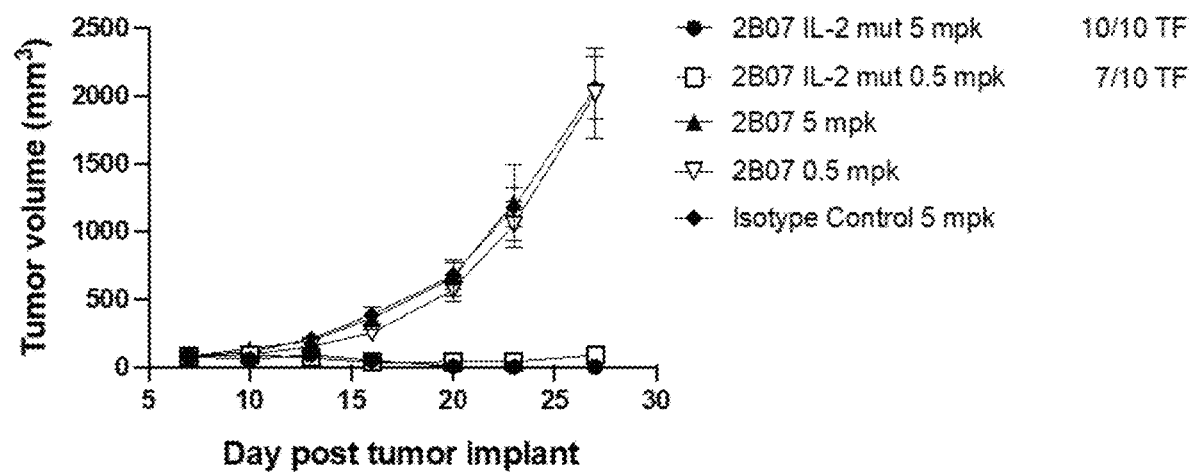
FIG. 20 provides tumor volume measurements as a function of the number of days post tumor cell implant in mice. Mice received various intravenous doses of a PD-1/IL-2 DBA-IL-2 complex, a PD-1/IL-2 DBA complex lacking IL-2, or an isotype control.
Figure 21A:
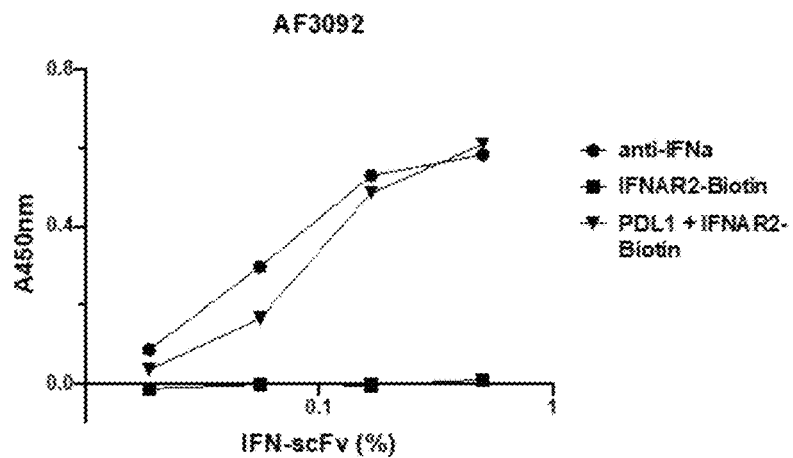
FIG. 21A-F provide results for IFNAR2 binding in the presence (triangles) and absence (squares) of PD-L1 for six separate DBA PDL1-IFN variants.
Figure 21B:
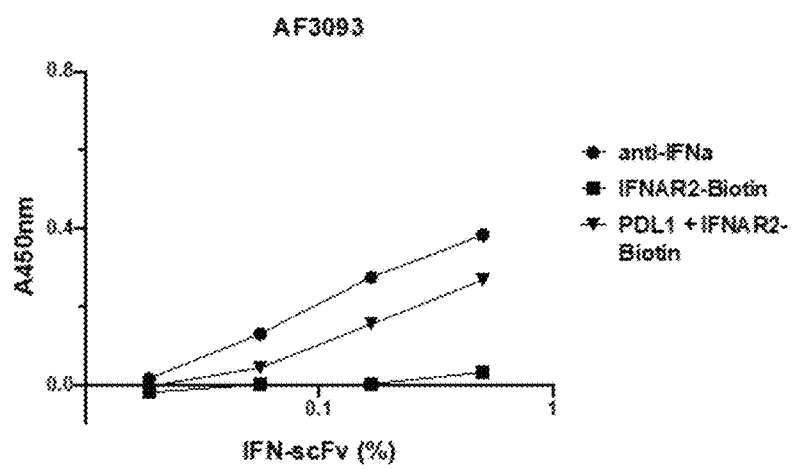
Figure 21C:
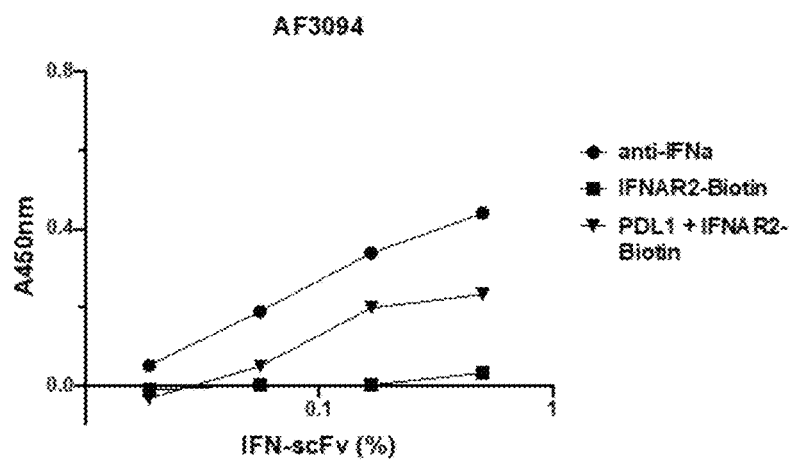
Figure 21D:
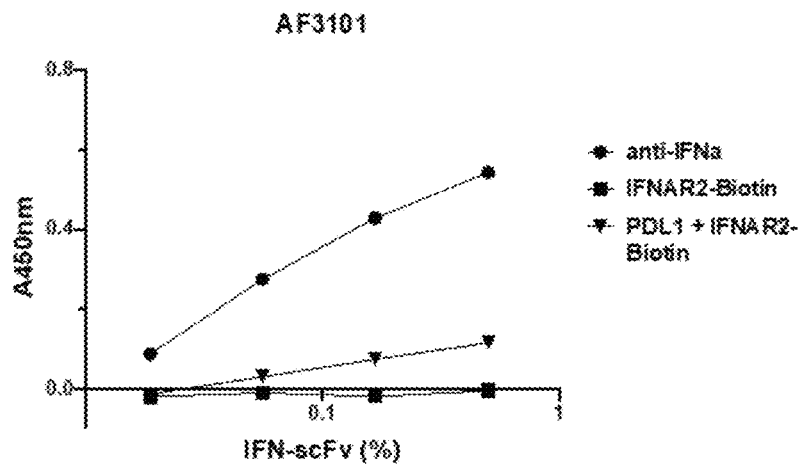
Figure 21E:
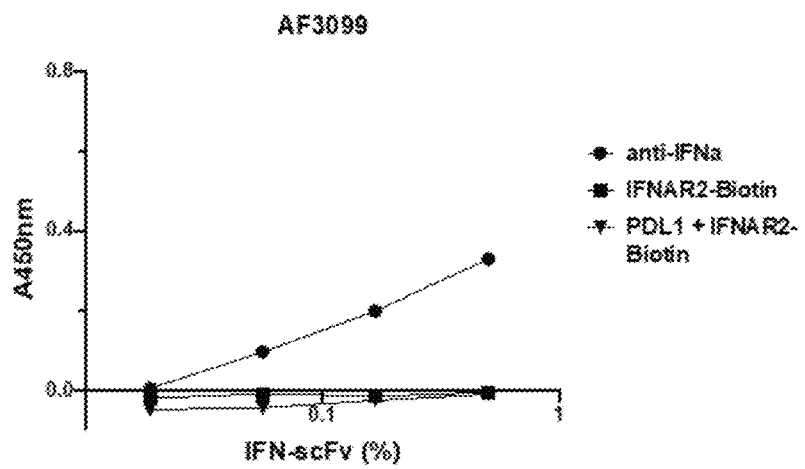
Figure 21F:
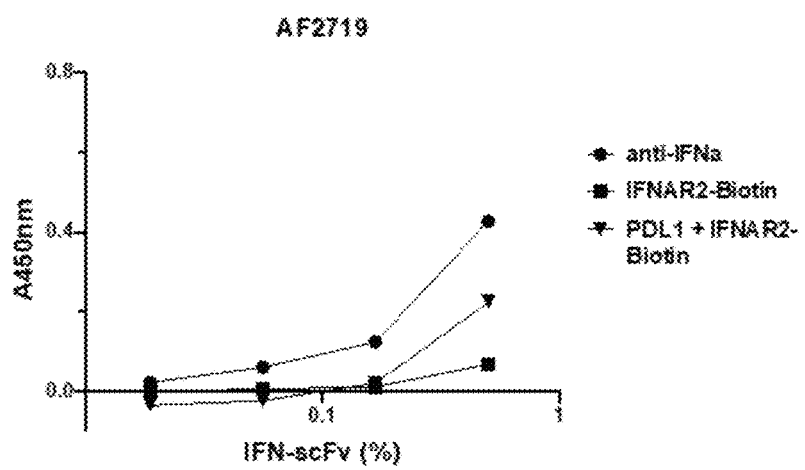
Figure 22A:
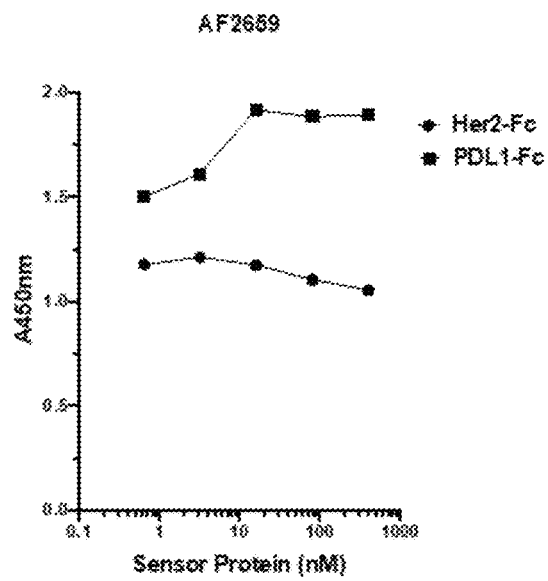
FIG. 22A-H provide IFNAR2 binding by five PD-L1/IFNα DBA-cytokine complexes and three control complexes.
Figure 22B:
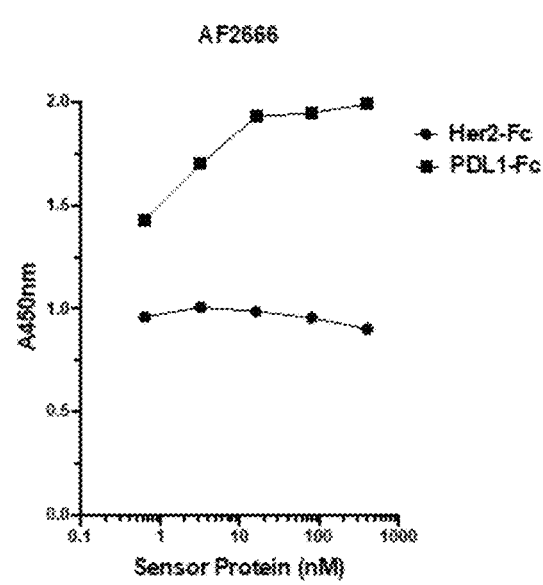
Figure 22C:
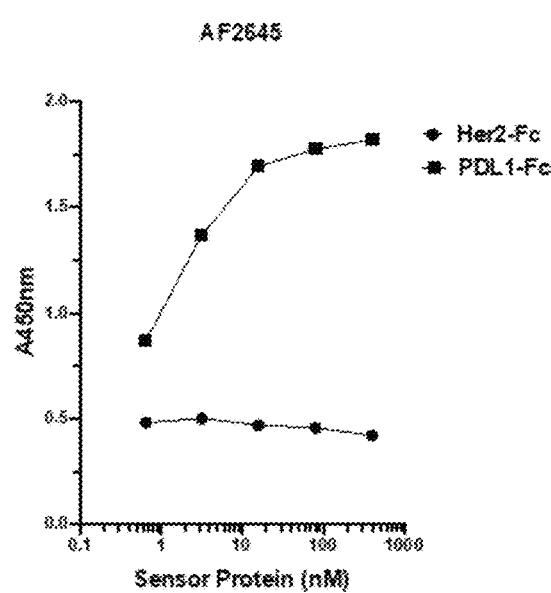
Figure 22D:
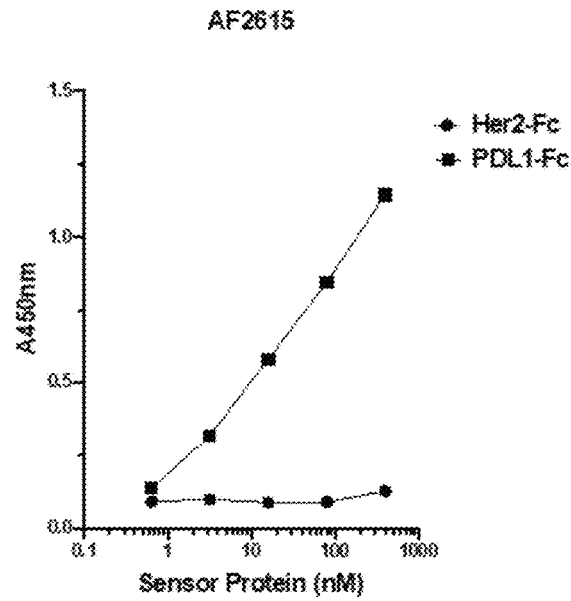
Figure 22E:
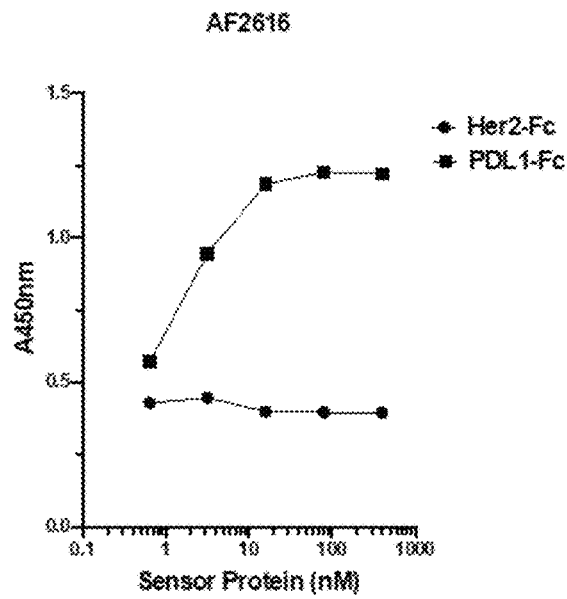
Figure 22F:
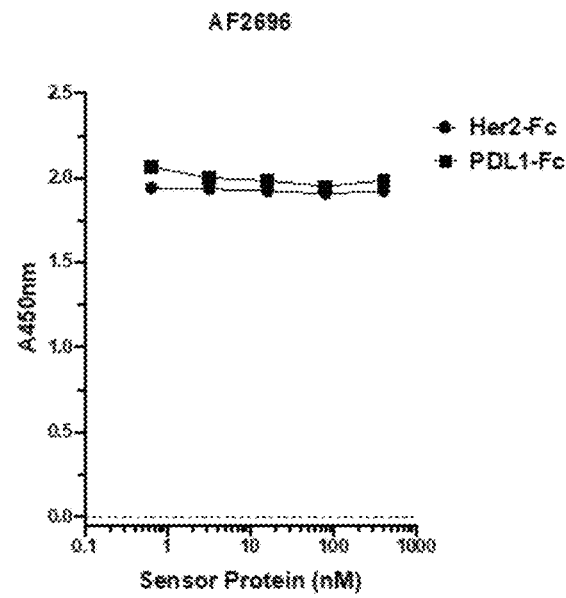
Figure 22G:
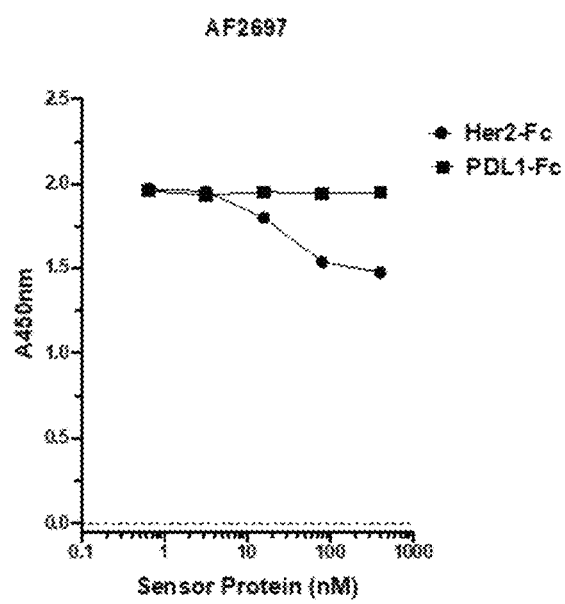
Figure 22H:
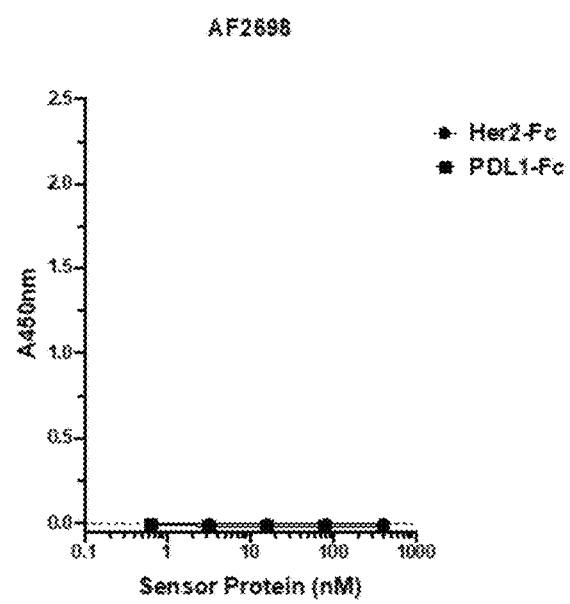
Figure 23A:
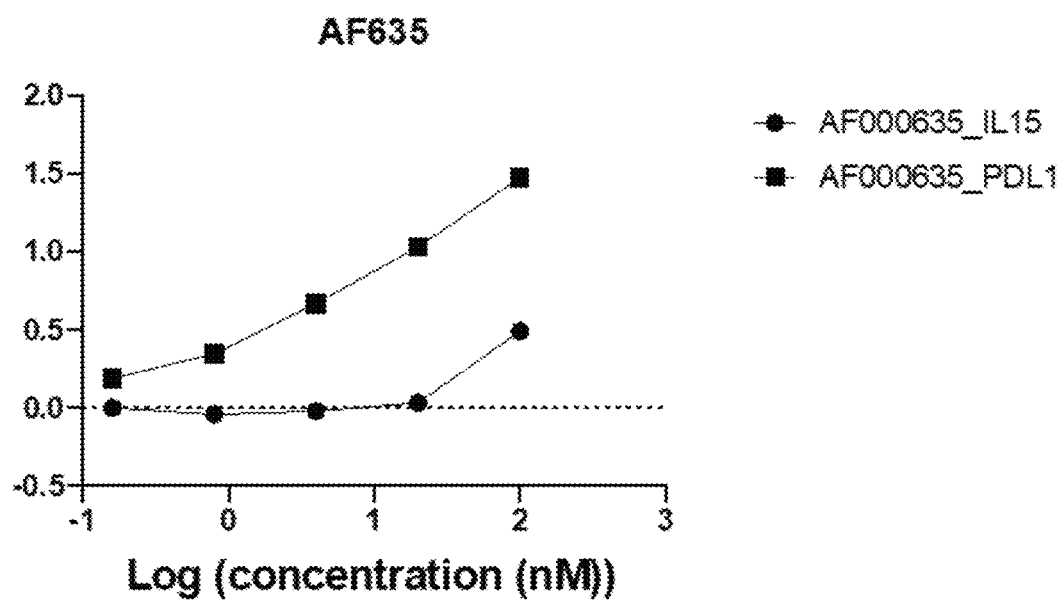
FIG. 23A-D provide ELISA measurements for PD-L1 and IL-15 binding by four separate anti-PD-L1 and anti-IL-15 DBAs.
Figure 23B:
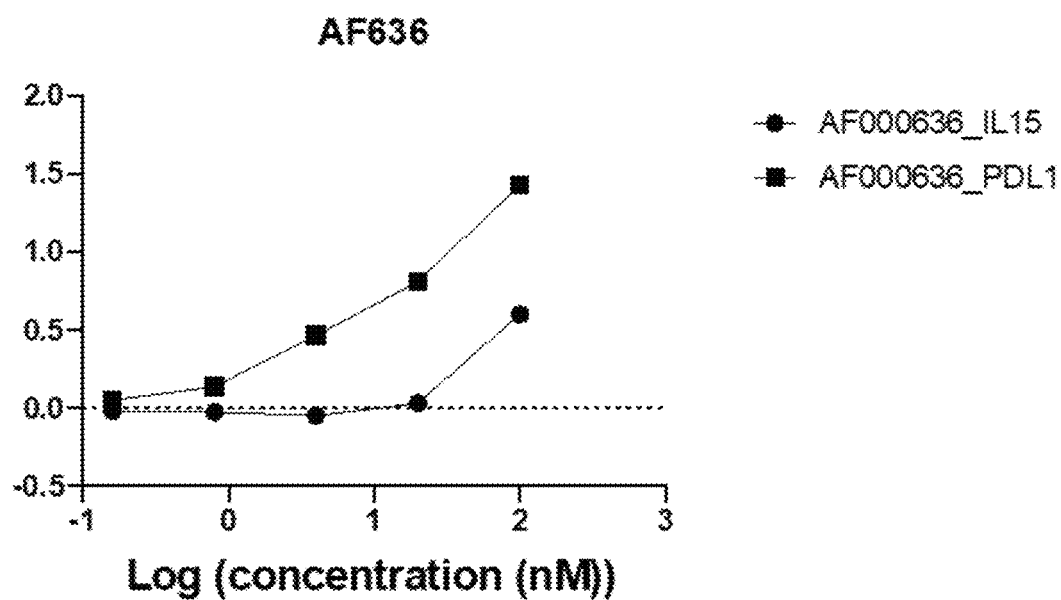
Figure 23C:
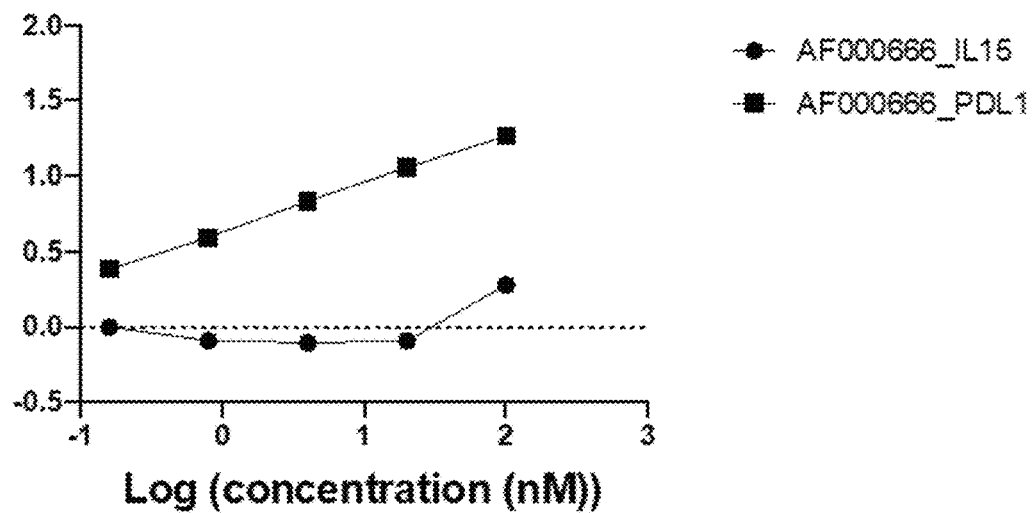
Figure 23D:
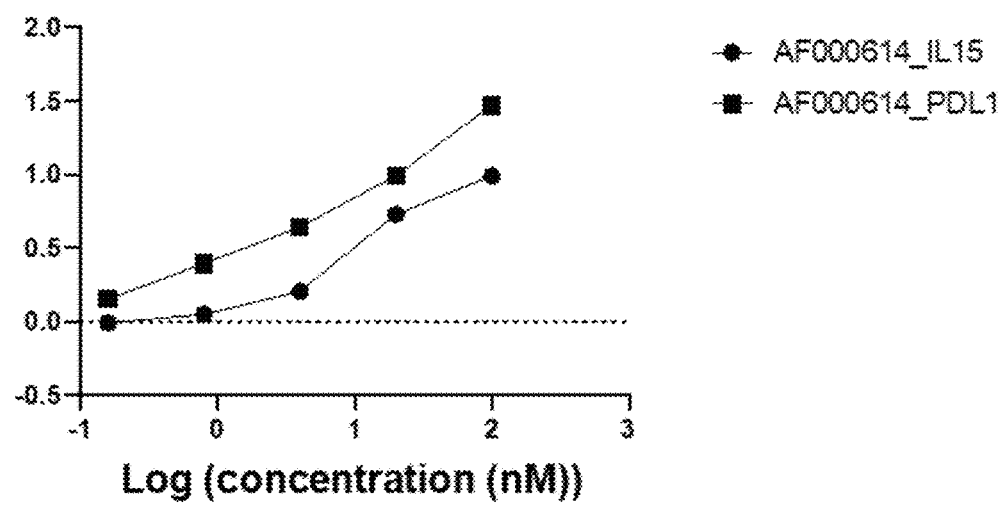
Figure 24A:
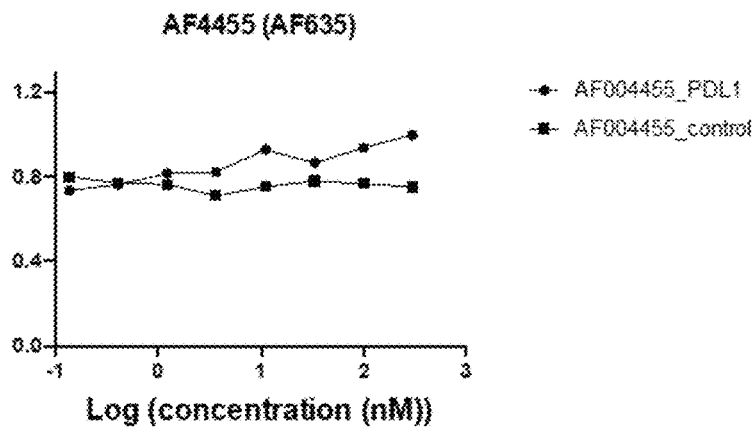
FIG. 24A-F provide IL-15 activity as measured by HEK-Blue™ IL-2 reporter cell colorimetric responses for four scFv DBA-IL-15 complexes and two monospecific anti-IL-15 antibody IL-15 complexes.
Figure 24B:
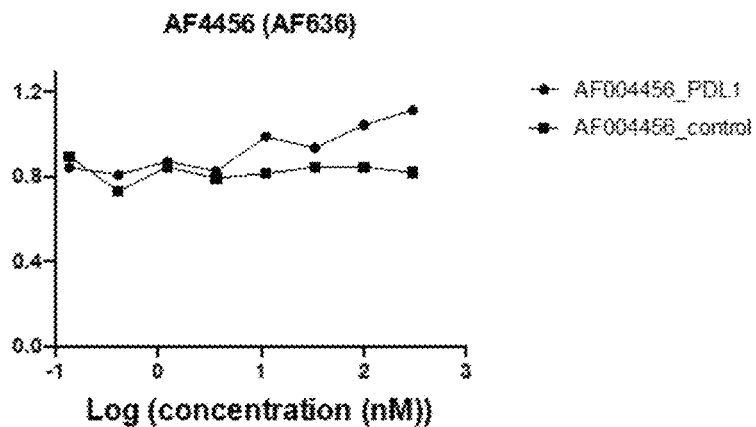
Figure 24C:
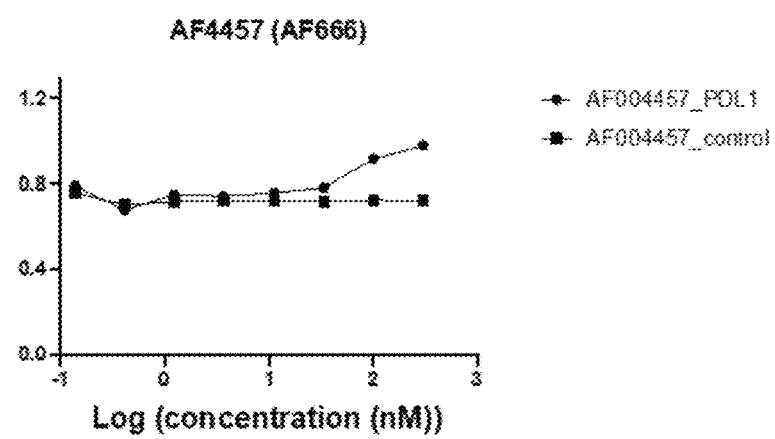
Figure 24D:
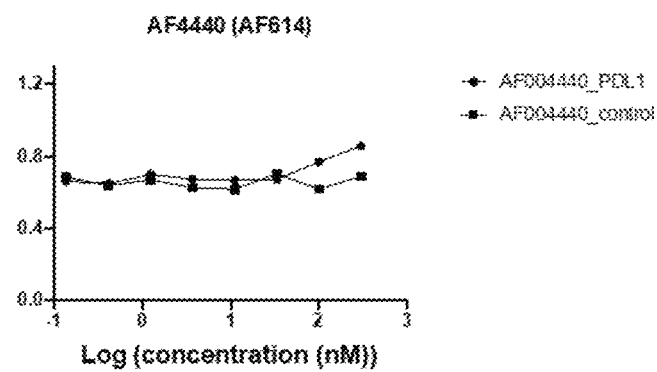
Figure 24E:
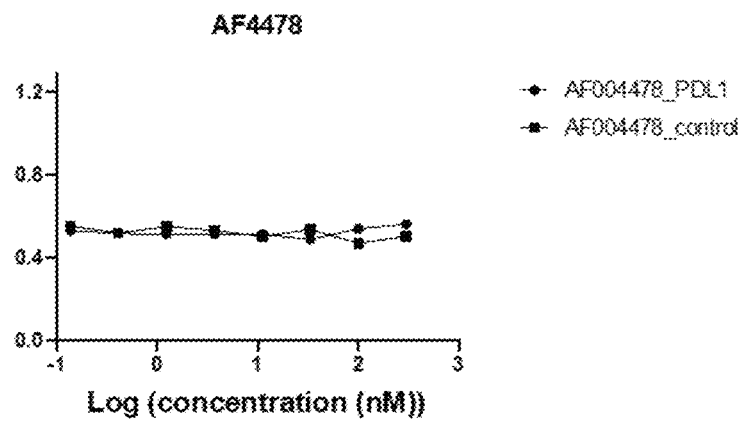
Figure 24F:
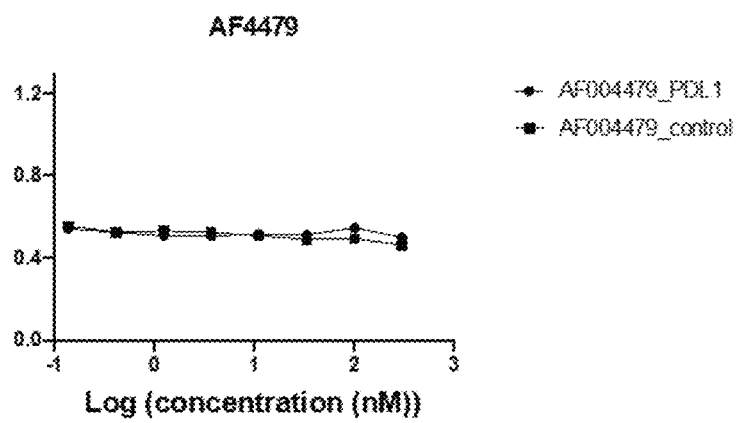
Figure 25A:
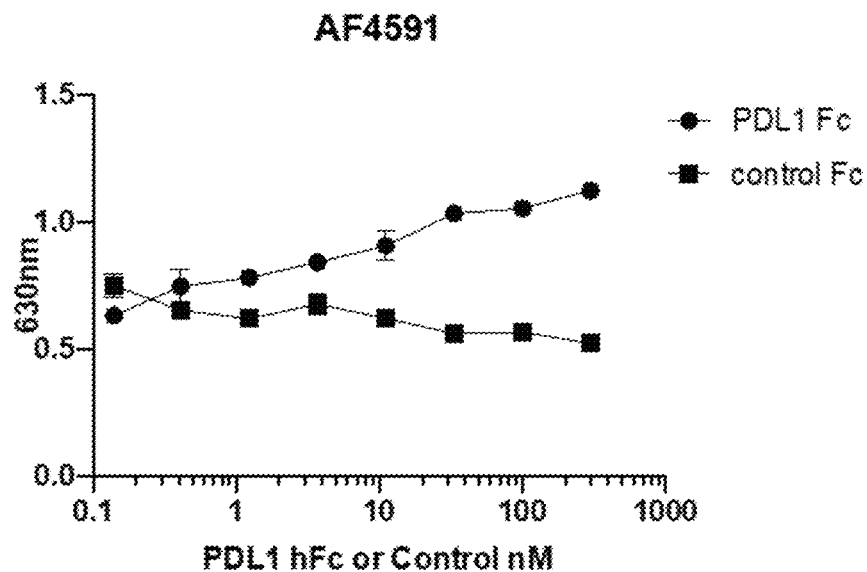
FIG. 25A-D provide IL-15 activity as measured by HEK-Blue™ IL-2 reporter cell colorimetric responses for two DBA-IL-15 complexes and PDL1-IFN DBA control protein complexes.
Figure 25B:
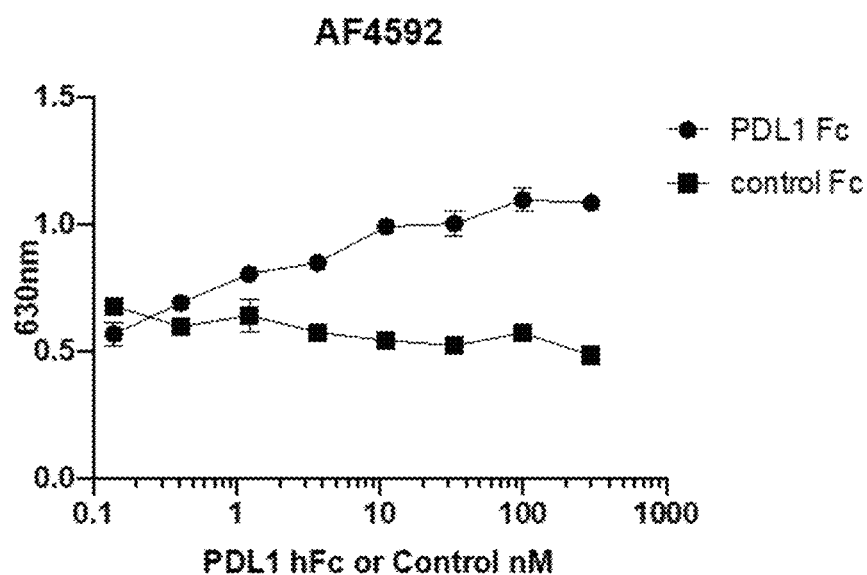
Figure 25C:
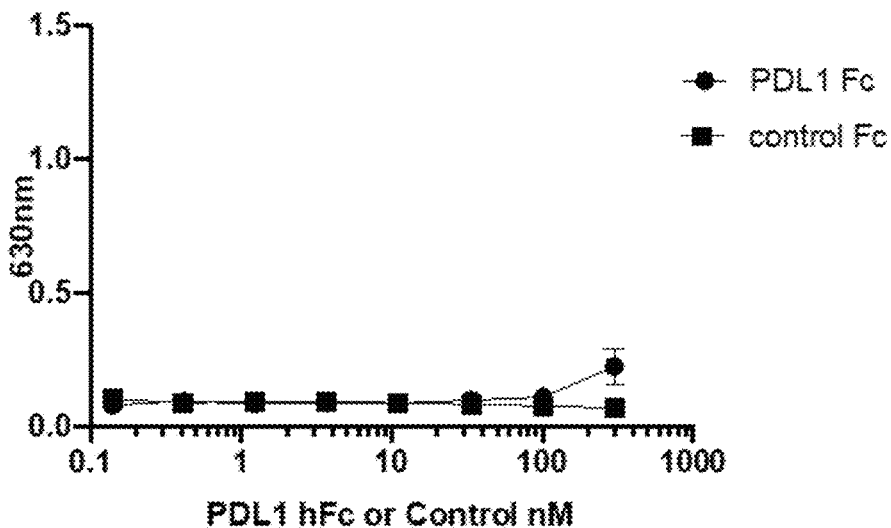
Figure 25D:
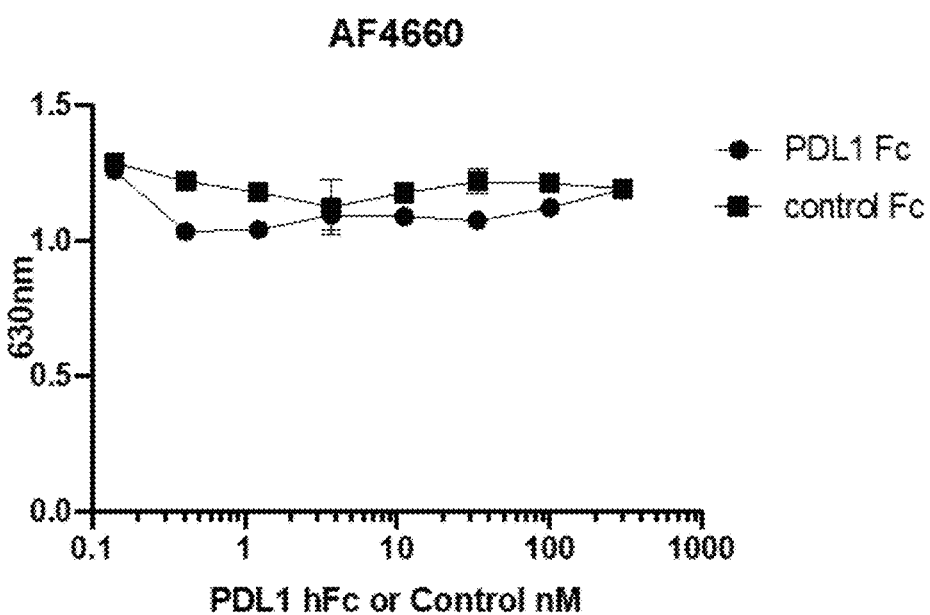

PD-1/IL-2 DBA Cytokine Complex Modulation of Anti-Tumor Immunity in Syngeneic Tumor Models This example describes PD-1/IL-2 DBA-cytokine complex modulation of anti-tumor immunity in a MC38 syngeneic mouse tumor model. A PD-1/IL-2 DBA-cytokine complex was assessed for the ability to drive anti-tumor immunity in vivo. 500,000 MC38 tumor cells were implanted subcutaneously in human PD-1 knock-in mice (GenOway). Tumors were measured twice weekly, and volumes calculated as (Length×Width×Width/2). Mice were randomized into treatment groups, and treatments were initiated when tumors reached a volume of ~100 mm$^3$. Mice were treated intravenously with PD-1/IL-2 DBA-cytokine complex (2B07 IL-2 mut; SEQ ID NO: 210-212), PD-1/IL-2 DBA lacking IL-2 (2B07; SEQ ID NO: 212-213), or an isotype control (SEQ ID NO: 214-215), as shown in TABLE 21 below, at the indicated doses of 5 or 0.5 milligrams per kilogram on days 7, 10, and 13 post tumor implantation. The PD-1/IL-2 DBA-cytokine complex showed increased tumor growth inhibition compared to either the PD-1/IL-2 DBA lacking IL-2 or the isotype control (FIG. 20).

TABLE 21

IgG PD-1/IL-2 DBA and control protein complexes

| Protein Complex | SEQ ID NO: | Sequence |
|---|---|---|
| 2B07 IL-2 mut | SEQ ID NO: 210 | APASSSTKKTQLQLEHLLLDLQMILNGINNYKNPKLTRMLTAKFAMPKKATELKHL QCLEEELKPLEEVLNGAQSKNFHLRPRDLISNINVIVLELKGSETTFMCEYADETATIV EFLNRWITFAQSIISTLTGGGGSGGGGSGGGGSGGGGSQVQLVQSGAEVKKPGAS VKVSCKASGDTFTRYYVHWVRQAPGQGLEWMGIINPSGGYASYAQKFQGRVTM TRDTSTSTVYMELSSLRSEDTAVYYCAAGLFIWGQGTLVTVSSAKTTAPSVYPLAPV CGDTTGSSVTLGCLVKGYFPEPVTLTWNSGSLSSGVHTFPAVLQSDLYTLSSSVTVT SSTWPSQSITCNVAHPASSTKVDKKIEPRGPTIKPCPPCKCPAPNAAGGPSVFIFPPK IKDVLMISLSPIVTCVVVDVSEDDPDVQISWFVNNVEVHTAQTQTHREDYNSTLRV VSALPIQHQDWMSGKEFKCKVNNKDLGAPIERTISKPKGSVRAPQVYVLPPPEEE MTKKQVTLTCMVTDFMPEDIYVEWTNNGKTELNYKNTEPVLDSDGSYFMYSDLR VEKKNWVERNSYSCSVVHEGLHNHHTTESFSRTPGK |
| | SEQ ID NO: 211 | QVQLVQSGAEVKKPGASVKVSCKASGDTFTRYYVHWVRQAPGQGLEWMGIINPS GGYASYAQKFQGRVTMTRDTSTSTVYMELSSLRSEDTAVYYCAAGLFIWGQGTLV TVSSAKTTAPSVYPLAPVCGDTTGSSVTLGCLVKGYFPEPVTLTWNSGSLSSGVHTF PAVLQSDLYTLSSSVTVTSSTWPSQSITCNVAHPASSTKVDKKIEPRGPTIKPCPPCK CPAPNAAGGPSVFIFPPKIKDVLMISLSPIVTCVVVDVSEDDPDVQISWFVNNVEV HTAQTQTHREDYNSTLRVVSALPIQHQDWMSGKEFKCKVNNKDLGAPIERTISKP KGSVRAPQVYVLPPPEKEMTKKQVSLTCLVKDFMPEDIYVEWTNNGKTELNYKNT EPVLKSDGSYFMYSKLTVEKKNWVERNSYSCSVVHEGLHNHHTTKSFSRTPGK |
| | SEQ ID NO: 212 | DIQMTQSPSSLSASVGDRVTITCRASQSIGRYLAWYQQKPGKAPKLLIYSASNLETG VPSRFSGSGSGTDFTLTISSLQPEDFATYYCQQYNSFPVTFGPGTKVDIKRADAAPT VSIFPPSSEQLTSGGASVVCFLNNFYPKDINVKWKIDGSERQNGVLNSWTDQDSK DSTYSMSSTLTLTKDEYERHNSYTCEATHKTSTSPIVKSFNRNEC |

TABLE 21-continued

IgG PD-1/IL-2 DBA and control protein complexes

| Protein Complex | SEQ ID NO: | Sequence |
|---|---|---|
| PD-1/IL-2 DBA lacking IL-2 | SEQ ID NO: 212 | DIQMTQSPSSLSASVGDRVTITCRASQSIGRYLAWYQQKPGKAPKLLIYSASNLETG VPSRFSGSGSGTDFTLTISSLQPEDFATYYCQQYNSFPVTFGPGTKVDIKRADAAPT VSIFPPSSEQLTSGGASVVCFLNNFYPKDINVKWKIDGSERQNGVLNSWTDQDSK DSTYSMSSTLTLTKDEYERHNSYTCEATHKTSTSPIVKSFNRNEC |
| | SEQ ID NO: 213 | QVQLVQSGAEVKKPGASVKVSCKASGDTFTRYYVHWVRQAPGQGLEWMGIINPS GGYASYAQKFQGRVTMTRDTSTSTVYMELSSLRSEDTAVYYCAAGLFIWGQGTLV TVSSAKTTAPSVYPLAPVCGDTTGSSVTLGCLVKGYFPEPVTLTWNSGSLSSGVHTF PAVLQSDLYTLSSSVTVTSSTWPSQSITCNVAHPASSTKVDKKIEPRGPTIKPCPPCK CPAPNAAGGPSVFIFPPKIKDVLMISLSPIVTCVVVDVSEDDPDVQISWFVNNVEV HTAQTQTHREDYNSTLRVVSALPIQHQDWMSGKEFKCKVNNKDLGAPIERTISKP KGSVRAPQVYVLPPPEEEMTKKQVTLTCMVTDFMPEDIYVEWTNNGKTELNYKN TEPVLDSDGSYFMYSKLRVEKKNWVERNSYSCSVVHEGLHNHHTTKSFSRTPGK |
| isotype control | SEQ ID NO: 214 | EVQLVESGGGLVQPGGSLRLSCAASGFNIKDTYIHWVRQAPGKGLEWVARIYPTN GYTRYADSVKGRFTISADTSKNTAYLQMNSLRAEDTAVYYCSRWGGDGFYAMDY WGQGTLVTVSSAKTTAPSVYPLAPVCGDTTGSSVTLGCLVKGYFPEPVTLTWNSGS LSSGVHTFPAVLQSDLYTLSSSVTVTSSTWPSQSITCNVAHPASSTKVDKKIEPRGPT IKPCPPCKCPAPNAAGGPSVFIFPPKIKDVLMISLSPIVTCVVVDVSEDDPDVQISWF VNNVEVHTAQTQTHREDYNSTLRVVSALPIQHQDWMSGKEFKCKVNNKDLGAPI ERTISKPKGSVRAPQVYVLPPPEEEMTKKQVTLTCMVTDFMPEDIYVEWTNNGKT ELNYKNTEPVLDSDGSYFMYSKLRVEKKNWVERNSYSCSVVHEGLHNHHTTKSFSR TPGK |
| | SEQ ID NO: 215 | DIQMTQSPSSLSASVGDRVTITCRASQDVNTAVAWYQQKPGKAPKLLIYSASFLYS GVPSRFSGSRSGTDFTLTISSLQPEDFATYYCQQHYTTPPTFGQGTKVEIKRADAAP TVSIFPPSSEQLTSGGASVVCFLNNFYPKDINVKWKIDGSERQNGVLNSWTDQDSK DSTYSMSSTLTLTKDEYERHNSYTCEATHKTSTSPIVKSFNRNEC |

Example 19

PD-1/IL-2 DBA Cytokine Complex Modulation of Anti-Tumor Immunity in Xenograft/Human Immune Cell Admixture Models This example describes PD-1/IL-2 DBA-cytokine complex modulation of anti-tumor immunity in xenograft/human immune cell admixture models. To examine the ability of PD-1/IL-2 DBA-cytokine complexes to drive anti-tumor immunity in an in vivo setting, an admixture system is used. Total human PBMCs or a combination of human T cells and monocyte-derived dendritic cells (moDCs) are mixed with human tumor cells (e.g., HPAC, A375, H441) at a 1:4 ratio and co-implanted subcutaneously into the flanks of NSG mice. One day later, treatment with a PD-1/IL-2 DBA-cytokine complex of the present disclosure, or suitable non-regulated controls such as anti-PD-1, anti-HER2-IL-2, or anti-PD-1-IL-2, is initiated. Tumors are measured at least twice weekly and volumes calculated as (Length×Width×Height/2). PD-1/IL-2 DBA-cytokine complexes exhibit increased anti-tumor efficacy compared to anti-PD-1 and anti-HER2-IL-2 and decreased off-tumor activity compared to anti-PD-1-IL-2.

Example 20

PD-L1/IFN-α DBA Cytokine Complex Induction of Myeloid Cell Maturation in the Presence of Plate-Bound PD-L1 or PD-L1-Expressing Tumor Cells This example describes PD-L1/IFN-α DBA-cytokine complex induction of myeloid cell maturation in the presence of plate-bound PD-L1 or PD-L1-expressing tumor cells. CD14+ monocytes are purified from fresh human PBMCs by immunomagnetic negative selection (STEMCELL). Monocyte-derived dendritic cells (moDCs) are generated by culturing purified monocytes with hGM-CSF and hIL-4 in RPMI-1640 medium containing 10% FBS for 5 days. To examine the conditional activity of PD-L1/IFN-α DBA-cytokine complex, monocytes or moDCs are added to plates coated with either PD-L1 or HER-2 along with titrating concentrations of a PD-L1/IFN-α DBA-cytokine complex of the present disclosure. In some experiments, human monocytes or moDCs are co-cultured with tumor cell lines expressing varying levels of PD-L1 and titrating concentrations of PD-L1/IFN-α DBA-cytokine complex. Cultures are incubated overnight at 37° C., and expression of CD80, CD83, CD86, and HLA-DR is assessed by flow cytometry as a measurement of myeloid cell activation. PD-L1/IFN-α DBA-cytokine complex is expected to induce monocyte and moDC activation solely in the presence of PD-L1.

Example 21

PD-L1/IFN-α DBA Cytokine Complex Induction of T cell Activation in a Mixed Lymphocyte Reaction This example describes PD-L1/IFN-α DBA-cytokine complex induction of T cell activation in a mixed lymphocyte reaction. To assess the direct and indirect effects of PD-L1/IFN-α DBA-cytokine complex on T cell function, CD14+ monocytes are isolated from human PBMCs using immunomagnetic negative selection (STEMCELL) and cultured for 5 days in the presence of hGM-CSF and hIL-4 to induce moDCs. CD8+ T cells are purified from human PBMCs of a different healthy donor and labeled with cell proliferation dye. The two cell types are combined in plates coated with PD-L1 or HER2 along with titrating concentrations of a PD-L1/IFN-α DBA-cytokine complex of the present disclosure. In other experiments, the two cell types are cultured with titrating concentrations of PD-L1/IFN-α DBA-cytokine complex and tumor cell lines expressing varying levels of PD-L1. In other experiments, the cells may be of mouse origin. Cultures are incubated for 5 days, and T cell dye dilution is assessed by flow cytometry as a measurement of proliferation. The concentration of cytokines (e.g., IFN-γ) in culture supernatants is assessed by ELISA. The PD-L1/IFN-α DBA-cytokine complex increases T cell activation and proliferation solely in the presence of PD-L1.

Example 22

In Vivo PD-L1/IFN-α DBA Cytokine Complex Signaling in Peripheral Tissues

This example describes in vivo PD-L1/IFN-α DBA-cytokine complex signaling in peripheral tissues. To examine PD-L1/IFN-α DBA-cytokine complex activity in non-tumor tissue, wild-type C57BL/6 mice are injected intravenously (i.v.) with 100 ug of either a PD-L1/IFN-α DBA-cytokine complex of the present disclosure or a non-regulated immunocytokine of a comparable structure consisting of anti-PD-L1 and IFN-α (PD-L1-IFNα immunocytokine). Animals are weighed daily to monitor IFN-α induced toxicity. Serum is collected at 6 and 24 hours post dosing, and MCP-1, IL-6, IL-10, TNF-α, and IFN-γ levels are quantified by ELISA. In some groups, RNA is isolated from the spleen and liver 6 and 24 hours post dosing. Induction of IFN-stimulated genes including ISG15, IRF7, and MX2 is assessed by qPCR. Mice that received unregulated anti-PD-L1-IFN-α immunocytokine experience weight loss, increased serum cytokine levels, and IFN target gene induction, whereas those dosed with the PD-L1/IFN-α DBA-cytokine complex display minimal evidence of peripheral IFN-α signaling.

Example 23

PD-L1-IFN-α DBA-Cytokine Complex Modulation of Anti-Tumor Immunity in Syngeneic Tumor Models This example describes PD-L1/IFN-α DBA-cytokine complex modulation of anti-tumor immunity in syngeneic tumor models. PD-L1/IFN-α DBA cytokine complex proteins are assessed for their ability to drive anti-tumor immunity in vivo. Wild-type or human PD-L1-expressing syngeneic mouse tumor cells (e.g., MC38, CT26, 4T1, or A20) are implanted subcutaneously into wild-type or human PD-L1 knock-in mice (Genoway). Tumors are measured at least twice weekly and volumes are calculated as (Length×Width×Height/2). Mice are randomized into different groups and therapy is initiated when tumors reached a volume of ~100 mm³. Mice are treated i.v. or intratumorally with a PD-L1/IFN-α DBA-cytokine complex of the present disclosure or suitable nonregulated controls such as anti-PD-L1, anti-HER2-IFN-α immunocytokine, or anti-PD-L1-IFN-α immunocytokine. In some experiments, mice are sacrificed 5 days post treatment, and tumors are harvested and enzymatically dissociated for immunophenotyping. The frequency and phenotype of tumor-infiltrating immune cell subsets, including CD4+ and CD8+ T cells, Treg cells, NK cells, and DCs, is determined by flow cytometry. The PD-L1/IFN-α DBA-cytokine complex inhibits tumor growth to an equal or greater extent than anti-HER2-IFN-α, but with less off-tumor activity. The PD-L1/IFNα DBA-cytokine complex increases an anti-tumor immune response as indicated by the amount and phenotype of immune infiltrates to an equal or greater extent than anti-HER2-IFNα immunocytokine, but with less off-tumor activity.

Example 24

PD-L1/IFN-α DBA Modulation of Anti-Tumor Immunity in Xenograft/Human Immune Cell Admixture Models This example describes PD-L1/IFN-α DBA-cytokine complex modulation of anti-tumor immunity in xenograft/human immune cell admixture models. To examine the ability of PD-L1/IFN-α DBA-cytokine complexes to drive anti-tumor immunity in an in vivo setting, an admixture system is used. Total human PBMCs or a combination of human T cells and moDCs are mixed with human tumor cells (e.g., HPAC, A375, H441) at a 1:4 ratio and co-implanted subcutaneously into the flanks of NSG mice. One day later, i.v. treatment with a PD-L1/IFN-α DBA-cytokine complex of the present disclosure or suitable non-regulated controls such as anti-PD-L1, anti-HER2-IFN-α immunocytokine, or anti-PD-L1-IFN-α immunocytokine is initiated. Tumors are measured at least twice weekly and volumes are calculated as (Length×Width×Height/2). The PD-L1/IFN-α DBA-cytokine complex inhibits tumor growth to an equal or greater extent than anti-HER2-IFN-α, but with less off-tumor activity.

Example 25

In Vitro and In Vivo Characterization of Protein Complexes

This example describes the evaluation of DBA-cytokine complexes for in vitro and in vivo stability. A protein complex of the present disclosure is recombinantly expressed or chemically synthesized. The protein complex includes a sensor domain linked to a therapeutic domain. The linker is a peptide linker. The sensor domain is capable of binding to the therapeutic domain and a marker. In the absence if the marker, the sensor domain binds the therapeutic domain rendering the therapeutic domain unable to bind to its target and unable to exert therapeutic activity. In the presence of the marker, the sensor domain binds the marker rendering the therapeutic domain free to bind to its target and able to exert therapeutic activity.

In vitro, the protein complexes are tested for stability and functionality at baseline or after incubation in conditions of stress, such as elevated temperature, pH changes, oxidative buffers, or serum/plasma, using methods of biophysical characterization to measure fragmentation, unfolding, or aggregation, and/or using methods to test for changes in functional activity. In vivo, the pharmacokinetic properties of the proteins are measured following dosing in a mammal, such as a mouse, rat, or non-human primate, and properties of distribution, clearance and degradation are measured. These measurements are used to engineer or select the optimal therapeutic form of the DBA-protein complex.

Example 26

Regulated IL-2 Receptor Signaling by a PD-1/IL-2 Dual Binding Antibody (DBA) Cytokine Complex This example describes PD-1 regulated IL-2 activity in a HEK-Blue™ IL-2 reporter cell by PD-1/IL-2 DBA-cytokine complexes. The DBA-cytokine complexes and control antibody-cytokine complexes were produced in three formats shown in FIGS. 14A-C by expression in mammalian cells using standard protocols. The wells of a 384-well ELISA plate were coated with constant concentration of PD-1-Fc or an IgG1 control protein captured with an anti-Fc antibody (Jackson ImmunoResearch, Prod. #109-005-098). The cytokine complexes were serially diluted 1:4 for 8 points in growth media from a starting concentration of 6 nM and incubated briefly before addition of the HEK-Blue™ IL-2 reporter cells.

Figure 14:
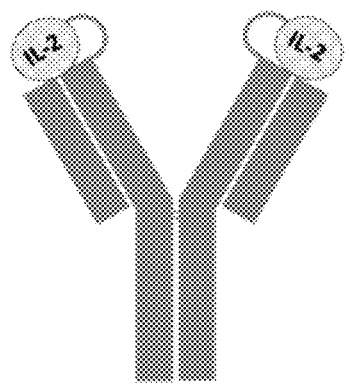
FIG. 14A-C illustrate immunoglobulin-containing protein complexes consistent with the present disclosure.
Figure 15A:
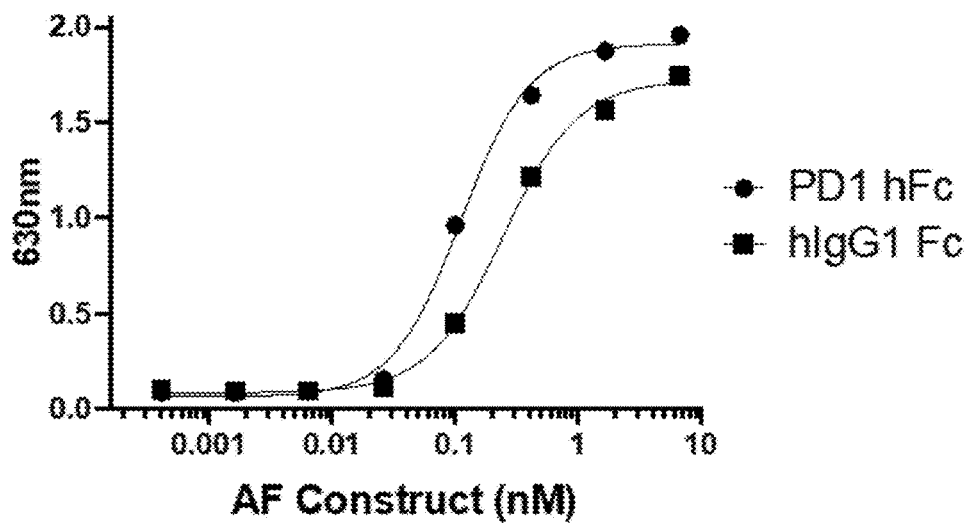
FIG. 15A-D provide IL-2 activity of IL-2-linked protein complexes comprising the structure depicted in FIG. 14A in wells coated with PD-1-Fc or an IgG1 control protein. Activity was measured as growth of a 630 nm signal from HEK-Blue™ IL-2 reporter cells (an engineered human kidney cell line which generates a detectable color change in upon activation of its IL-2 receptor).
Figure 15B:
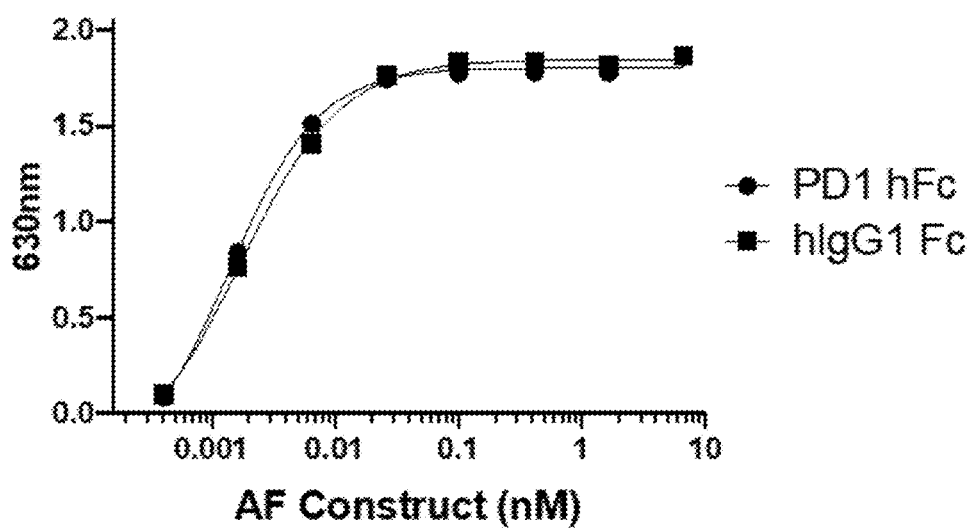
Figure 15C:
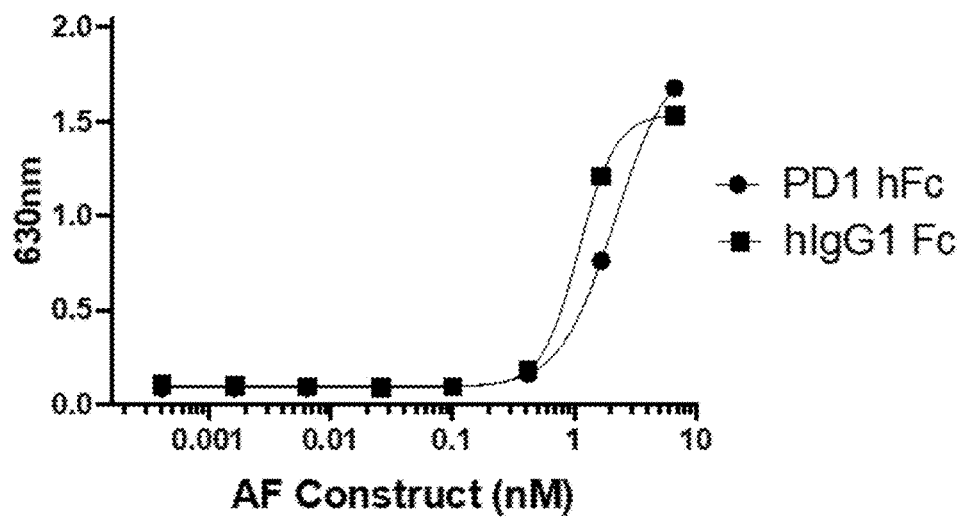
Figure 15D:
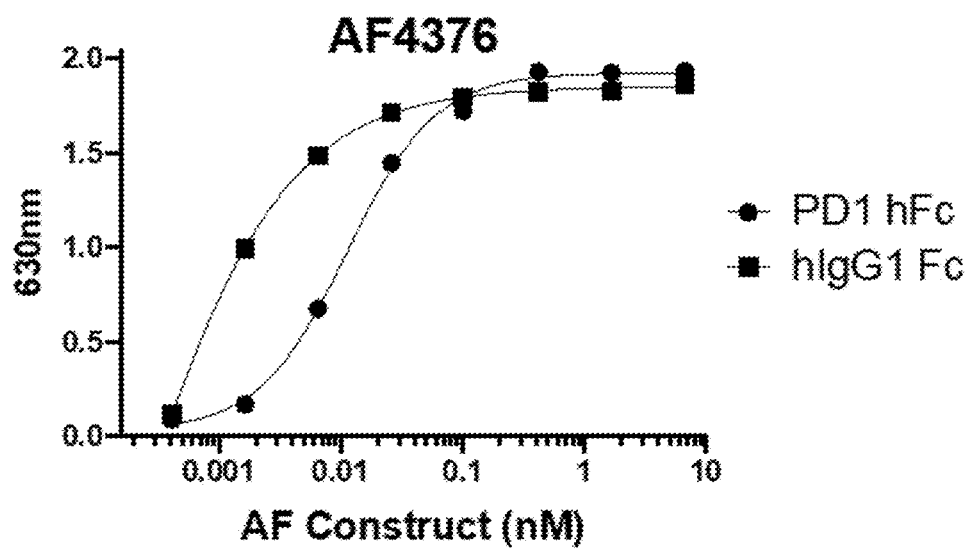
Figure 16A:
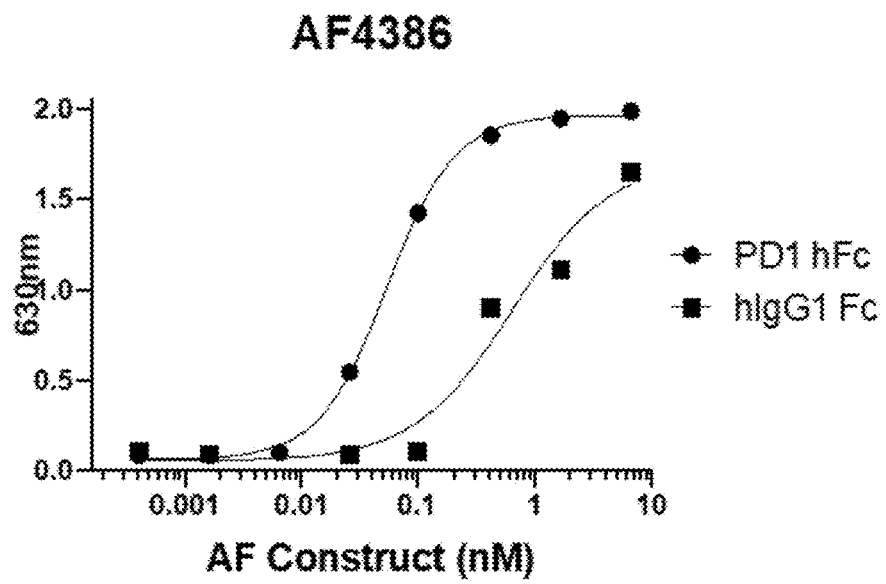
FIG. 16A-F provide IL-2 activity of protein complexes comprising the structure depicted in FIG. 14B in wells coated with PD-1-Fc or an IgG1 control protein. Activity was measured as growth of a 630 nm signal from HEK-Blue™ IL-2 reporter cells.
Figure 16B:
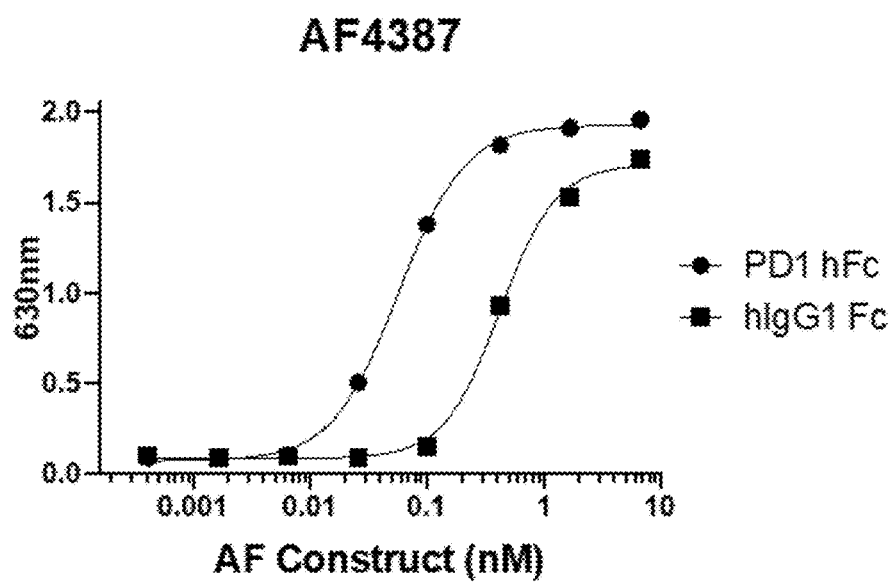
Figure 16C:
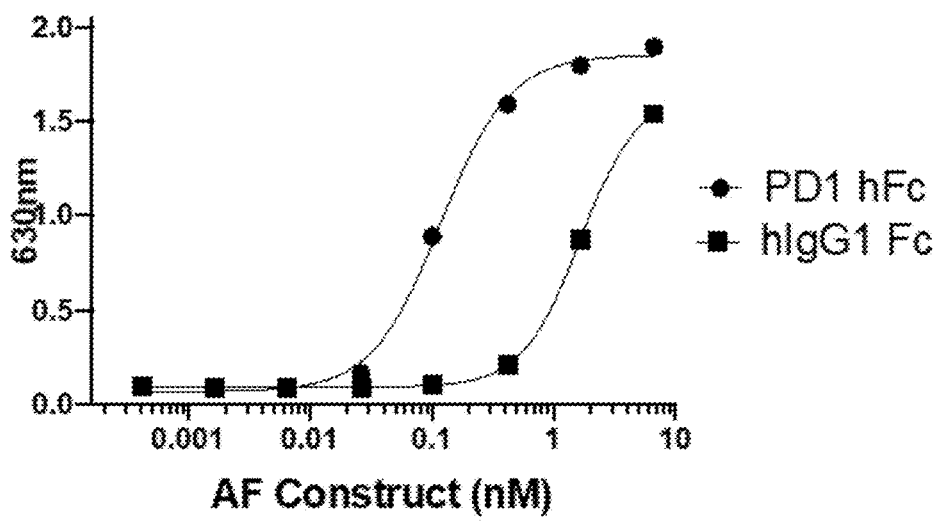
Figure 16D:
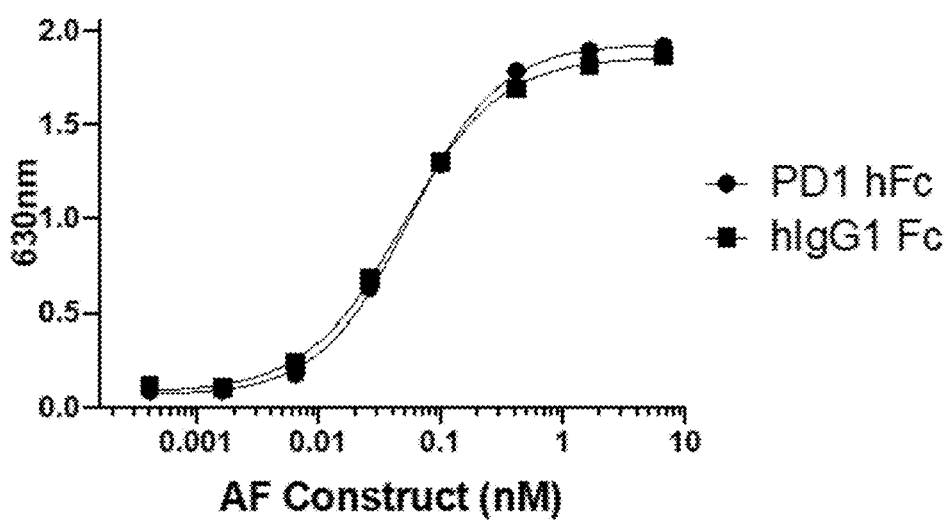
Figure 16E:
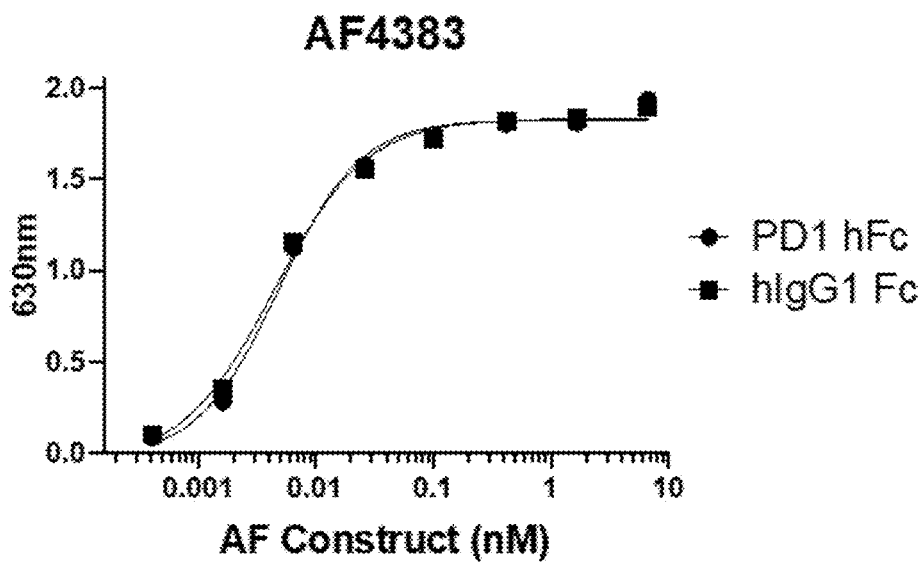
Figure 16F:
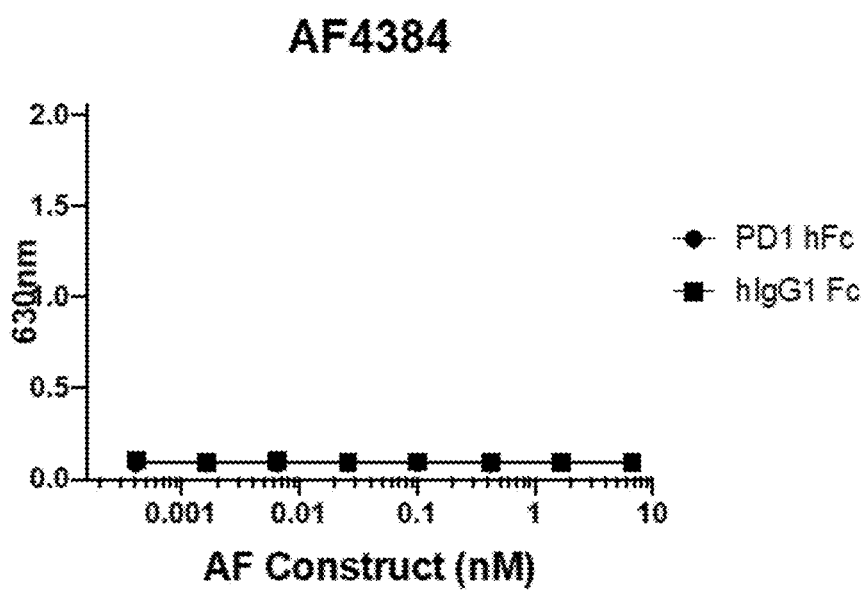

Results with a protein complexes comprising the structure shown in FIG. 14A are shown in FIG. 15A-D. As depicted in FIG. 14A, this symmetric format is comprised of one IL-2 linked to each antibody variable domain. The IL-2 activity of the PD-1/IL-2 DBA-IL-2 complex AF4379 comprising SEQ ID NO: 174-175 had an EC50 of 31 pM in the PD-1 coated wells versus 62 pM in the IgG1 coated wells, as shown in FIG. 15A, demonstrating PD-1 dependence. The IL-2 activity of antibody-cytokine complexes AF4377 comprising SEQ ID NO: 64 and 176 (anti-Her2 antibody) and AF4378 comprising SEQ ID NO: 177-178 (anti-IL-2 antibody) was unchanged in the presence of PD-1 (as shown in FIG. 15B and FIG. 15C, respectively), while the IL-2 activity of the anti-PD-1 antibody AF4376 comprising SEQ ID NO: 179-180 is reduced in the presence of PD-1, as shown in FIG. 15D. Sequences of the protein complexes are summarized in TABLE 22 below.

TABLE 22

IgG PD-1/IL-2 DBA with heavy chain IL-2 therapeutic domains, and control protein complexes

| Protein Complex | SEQ ID NO: | Sequence |
| --- | --- | --- |
| AF4379 | SEQ ID NO: 174 | APTSSSTKKTQLQLEHLLLDLQMILNGINNYKNPKLTDMLTFEFYM PKKATELKHLQCLERELKPLEEVLNLAQSKNFHLRPRDLISNINVIV LELKGSETTFMCEYADETATIVEFLNRWITFCQSIISTLTGGGGSGG GGSGGGGSGGGGSQVQLVQSGAEVKKPGASVKVSCKASGDTFTR YYVHWVRQAPGQGLEWMGIINPSGGYASYAQKFQGRVTMTRDTS TSTVYMELSSLRSEDTAVYYCAAGLFIWGQGTLVTVSSAKTTAPSV YPLAPVCGDTTGSSVTLGCLVKGYFPEPVTLTWNSGSLSSGVHTFP AVLQSDLYTLSSSVTVTSSTWPSQSITCNVAHPASSTKVDKKIEPRG PTIKPCPPCKCPAPNAAGGPSVFIFPPKIKDVLMISLSPIVTCVVVDV SEDDPDVQISWFVNNVEVHTAQTQTHREDYNSTLRVVSALPIQHQ DWMSGKEFKCKVNNKDLGAPIERTISKPKGSVRAPQVYVLPPPEEE MTKKQVTLTCMVTDFMPEDIYVEWTNNGKTELNYKNTEPVLDSD GSYFMYSKLRVEKKNWVERNSYSCSVVHEGLHNHHTTKSFSRTPG K |
| | SEQ ID NO: 175 | DIQMTQSPSSLSASVGDRVTITCRASQSIGRYLAWYQQKPGKAPKL LIYSASNLETGVPSRFSGSGSGTDFTLTISSLQPEDFATYYCQQYNSF PVTFGPGTKVDIKRADAAPTVSIFPPSSEQLTSGGASVVCFLNNFYP KDINVKWKIDGSERQNGVLNSWTDQDSKDSTYSMSSTLTLTKDEY ERHNSYTCEATHKTSTSPIVKSFNRNEC |
| AF4377 | SEQ ID NO: 64 | DIQMTQSPSSLSASVGDRVTITCRASQDVNTAVAWYQQKPGKAPK LLIYSASFLYSGVPSRFSGSRSGTDFTLTISSLQPEDFATYYCQQHYT TPPTFGQGTKVEIKRADAAPTVSIFPPSSEQLTSGGASVVCFLNNFY PKDINVKWKIDGSERQNGVLNSWTDQDSKDSTYSMSSTLTLTKDE YERHNSYTCEATHKTSTSPIVKSFNRNEC |
| | SEQ ID NO: 176 | APTSSSTKKTQLQLEHLLLDLQMILNGINNYKNPKLTDMLTFEFYM PKKATELKHLQCLERELKPLEEVLNLAQSKNFHLRPRDLISNINVIV LELKGSETTFMCEYADETATIVEFLNRWITFCQSIISTLTGGGGSGG GGSGGGGSGGGGSEVQLVESGGGLVQPGGSLRLSCAASGFNIKDT YIHWVRQAPGKGLEWVARIYPTNGYTRYADSVKGRFTISADTSKN TAYLQMNSLRAEDTAVYYCSRWGGDGFYAMDYWGQGTLVTVSS AKTTAPSVYPLAPVCGDTTGSSVTLGCLVKGYFPEPVTLTWNSGSL SSGVHTFPAVLQSDLYTLSSSVTVTSSTWPSQSITCNVAHPASSTKV DKKIEPRGPTIKPCPPCKCPAPNAAGGPSVFIFPPKIKDVLMISLSPIV TCVVVDVSEDDPDVQISWFVNNVEVHTAQTQTHREDYNSTLRVVS ALPIQHQDWMSGKEFKCKVNNKDLGAPIERTISKPKGSVRAPQVY VLPPPEEEMTKKQVTLTCMVTDFMPEDIYVEWTNNGKTELNYKNT EPVLDSDGSYFMYSKLRVEKKNWVERNSYSCSVVHEGLHNHHTT KSFSRTPGK |
| AF4378 | SEQ ID NO: 177 | APTSSSTKKTQLQLEHLLLDLQMILNGINNYKNPKLTDMLTFEFYM PKKATELKHLQCLERELKPLEEVLNLAQSKNFHLRPRDLISNINVIV LELKGSETTFMCEYADETATIVEFLNRWITFCQSIISTLTGGGGSGG GGSGGGGSEVQLVESGGGLVKPGGSLRLSCAASGFTFSSYT LAWVRQAPGKGLEWVAAIDSSSYTYSPDTVRGRFTISRDNAKNSL YLQMNSLRAEDTAVYYCARDSNWDALDYWGQGTLVTVSSAKTT APSVYPLAPVCGDTTGSSVTLGCLVKGYFPEPVTLTWNSGSLSSGV HTFPAVLQSDLYTLSSSVTVTSSTWPSQSITCNVAHPASSTKVDKKI EPRGPTIKPCPPCKCPAPNAAGGPSVFIFPPKIKDVLMISLSPIVTCVV VDVSEDDPDVQISWFVNNVEVHTAQTQTHREDYNSTLRVVSALPI QHQDWMSGKEFKCKVNNKDLGAPIERTISKPKGSVRAPQVYVLPP PEEEMTKKQVTLTCMVTDFMPEDIYVEWTNNGKTELNYKNTEPVL DSDGSYFMYSKLRVEKKNWVERNSYSCSVVHEGLHNHHTTKSFSR TPGK |

TABLE 22-continued

IgG PD-1/IL-2 DBA with heavy chain IL-2 therapeutic domains, and control protein complexes

| Protein Complex | SEQ ID NO: | Sequence |
|---|---|---|
| | SEQ ID NO: 178 | DIQMTQSPSSLSASVGDRVSITCKASQNVGTNVGWYQQKPGKAPK ALIYSASFRYSGVPSRFSGSGSGTDFTLTISSLQPEDFATYFCQQYYT YPYTFGGGTKLEIKRADAAPTVSIFPPSSEQLTSGGASVVCFLNNFY PKDINVKWKIDGSERQNGVLNSWTDQDSKDSTYSMSSTLTLTKDE YERHNSYTCEATHKTSTSPIVKSFNRNEC |
| AF4376 | SEQ ID NO: 179 | APTSSSTKKTQLQLEHLLLDLQMILNGINNYKNPKLTDMLTFEFYM PKKATELKHLQCLERELKPLEEVLNLAQSKNFHLRPRDLISNINVIV LELKGSETTFMCEYADETATIVEFLNRWITFCQSIISTLTGGGGSGG GGSGGGGSGGGGSQVQLVESGGGVVQPGRSLRLDCKASGITFSNS GMHWVRQAPGKGLEWVAVIWYDGSKRYYADSVKGRFTISRDNS KNTLFLQMNSLRAEDTAVYYCATNDDYWGQGTLVTVSSAKTTAP SVYPLAPVCGDTTGSSVTLGCLVKGYFPEPVTLTWNSGSLSSGVHT FPAVLQSDLYTLSSSVTVTSSTWPSQSITCNVAHPASSTKVDKKIEP RGPTIKPCPPCKCPAPNAAGGPSVFIFPPKIKDVLMISLSPIVTCVVV DVSEDDPDVQISWFVNNVEVHTAQTQTHREDYNSTLRVVSALPIQ HQDWMSGKEFKCKVNNKDLGAPIERTISKPKGSVRAPQVYVLPPP EEEMTKKQVTLTCMVTDFMPEDIYVEWTNNGKTELNYKNTEPVL DSDGSYFMYSKLRVEKKNWVERNSYSCSVVHEGLHNHHTTKSFSR TPGK |
| | SEQ ID NO: 180 | EIVLTQSPATLSLSPGERATLSCRASQSVSSYLAWYQQKPGQAPRLL IYDASNRATGIPARFSGSGSGTDFTLTISSLEPEDFAVYYCQQSSNW PRTFGQGTKVEIKRADAAPTVSIFPPSSEQLTSGGASVVCFLNNFYP KDINVKWKIDGSERQNGVLNSWTDQDSKDSTYSMSSTLTLTKDEY ERHNSYTCEATHKTSTSPIVKSFNRNEC |

Figure 14B:
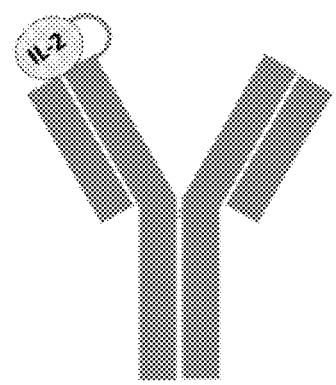
Figure 14C:
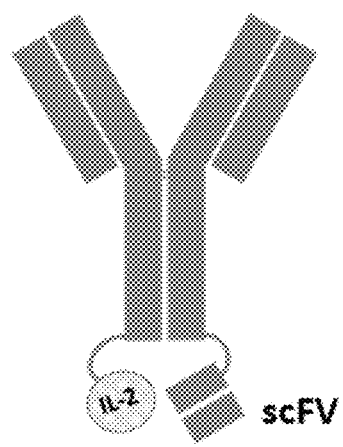

Results with protein complexes comprising the structures depicted in FIG. 14B, are shown in FIGS. 16A-F. This format is composed of an asymmetric complex comprised of two antibody domains with a single IL-2 linked to one of the domains. The IL-2 activity of the PD-1/IL-2 DBA-IL-2 complexes AF4386 (comprising SEQ ID NO: 212 and 181-182, results shown in FIG. 16A), AF4387 (comprising SEQ ID NO: 183-185, results shown in FIG. 16B) and AF4389 (comprising SEQ ID NO: 186-188, results shown in FIG. 16C) had an EC50 of 50 pM, 57 pM and 118 pM respectively in the PD-1 coated wells and 1.79 nM, 419 pM and 1.67 nM respectively in the IgG1 coated wells, demonstrating PD-1 dependence. The IL-2 activity of the anti-PD1 control protein AF4380 (comprising SEQ ID NO: 180, 189-190, results shown in FIG. 16D), the anti-Her2 control protein AF4383 (comprising SEQ ID NO: 64, 191-192, results shown in FIG. 16E), and the anti-IL-2 control protein AF4384 (comprising SEQ ID NO: 178, 193-194, results shown in FIG. 16F) were unchanged. Sequences of the protein complexes are summarized in TABLE 23 below.

TABLE 23

IgG PD-1/IL-2 PDA with single IL-2, and control protein complexes

| Protein Complex | SEQ ID NO: | Sequence |
|---|---|---|
| AF4386 | SEQ ID NO: 181 | APTSSSTKKTQLQLEHLLLDLQMILNGINNYKNPKLTDMLTFEFYMPKKATELKHLQ CLERELKPLEEVLNLAQSKNFHLRPRDLISNINVIVLELKGSETTFMCEYADETATIVE FLN RWITFCQSIISTLTGGGGSGGGGSGGGGSGGGGSQVQLVQSGAEVKKPGASV KVSCKASGDTFTRYYVHWVRQAPGQGLEWMGIINPSGGYASYAQKFQGRVTMT RDTSTSTVYMELSSLRSEDTAVYYCAAGLFIWGQGTLVTVSSAKTTAPSVYPLAPVC GDTTGSSVTLGCLVKGYFPEPVTLTWNSGSLSSGVHTFPAVLQSDLYTLSSSVTVTSS TWPSQSITCNVAHPASSTKVDKKIEPRGPTIKPCPPCKCPAPNAAGGPSVFIFPPKIK DVLMISLSPIVTCVVVDVSEDDPDVQISWFVNNVEVHTAQTQTHREDYNSTLRVV SALPIQHQDWMSGKEFKCKVNNKDLGAPIERTISKPKGSVRAPQVYVLPPPEEEMT KKQVTLTCMVTDFMPEDIYVEWTNNGKTELNYKNTEPVLDSDGSYFMYSDLRVEK KNWVERNSYSCSVVHEGLHNHHTTESFSRTPGK |
| | SEQ ID NO: 182 | QVQLVQSGAEVKKPGASVKVSCKASGDTFTRYYVHWVRQAPGQGLEWMGIINPS GGYASYAQKFQGRVTMTRDTSTSTVYMELSSLRSEDTAVYYCAAGLFIWGQGTLV TVSSAKTTAPSVYPLAPVCGDTTGSSVTLGCLVKGYFPEPVTLTWNSGSLSSGVHTF PAVLQSDLYTLSSSVTVTSSTWPSQSITCNVAHPASSTKVDKKIEPRGPTIKPCPPCK CPAPNAAGGPSVFIFPPKIKDVLMISLSPIVTCVVVDVSEDDPDVQISWFVNNVEV HTAQTQTHREDYNSTLRVVSALPIQHQDWMSGKEFKCKVNNKDLGAPIERTISKP KGSVRAPQVYVLPPPEKEMTKKQVSLTCLVKDFMPEDIYVEWTNNGKTELNYKNT EPVLKSDGSYFMYSKLTVEKKNWVERNSYSCSVVHEGLHNHHTTKSFSRTPGGGG SGGGSHHHHHH |
| | SEQ ID NO: 212 | DIQMTQSPSSLSASVGDRVTITCRASQSIGRYLAWYQQKPGKAPKLLIYSASNLETG VPSRFSGSGSGTDFTLTISSLQPEDFATYYCQQYNSFPVTFGPGTKVDIKRADAAPT VSIFPPSSEQLTSGGASVVCFLNNFYPKDINVKWKIDGSERQNGVLNSWTDQDSK DSTYSMSSTLTLTKDEYERHNSYTCEATHKTSTSPIVKSFNRNEC |

TABLE 23-continued

IgG PD-1/IL-2 PDA with single IL-2, and control protein complexes

| Protein Complex | SEQ ID NO: | Sequence |
|---|---|---|
| AF4387 | SEQ ID NO: 183 | APTSSSTKKTQLQLEHLLLDLQMILNGINNYKNPKLTDMLTFEFYMPKKATELKHLQCLERELKPLEEVLNLAQSKNFHLRPRDLISNINVIVLELKGSETTFMCEYADETATIVEFLNRWITFCQSIISTLTGGGGSGGGGSGGGGSGGGGSQVQLVQSGAEVKKPGASVKVSCKASGYTFTDYYMHWVRQAPGQGLEWMGIINPRAGYTSYALKFQGRVTMTRDTSTSTVYMELSSLRSEDTAVYYCTSGWDVWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFIVIYSDLRVEKKNWVERNSYSCSVVHEGLHNHHTTESFSRTPGK |
| | SEQ ID NO: 184 | QVQLVQSGAEVKKPGASVKVSCKASGYTFTDYYMHWVRQAPGQGLEWMGIINPRAGYTSYALKFQGRVTMTRDTSTSTVYMELSSLRSEDTAVYYCTSGWDVWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGSGGGSHHHHHH |
| | SEQ ID NO: 185 | DIQMTQSPSSLSASVGDRVTITCRASQSISTWLAWYQQKPGKAPKLLIYAASSLDSGVPSRFSGSGSGTDFTLTISSLQPEDFATYYCQQSYSFPVTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC |
| AF4389 | SEQ ID NO: 186 | APTSSSTKKTQLQLEHLLLDLQMILNGINNYKNPKLTDMLTFEFYMPKKATELKHLQCLERELKPLEEVLNLAQSKNFHLRPRDLISNINVIVLELKGSETTFMCEYADETATIVEFLNRWITFCQSIISTLTGGGGSGGGGSGGGGSGGGGSQVQLVQSGAEVKKPGASVKVSCKASGHTFTRYYMHWVRQAPGQGLEWMG11NPSGGYATYAQKFQGRVTMTRDTSTSTVYMELSSLRSEDTAVYYCASGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK |
| | SEQ ID NO: 187 | QVQLVQSGAEVKKPGASVKVSCKASGHTFTRYYMHWVRQAPGQGLEWMGIINPSGGYATYAQKFQGRVTMTRDTSTSTVYMELSSLRSEDTAVYYCASGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGSGGGSHHHHHH |
| | SEQ ID NO: 188 | DIQMTQSPSSLSASVGDRVTITCRASQSINSWLAWYQQKPGKAPKLLIYATSTLESGVPSRFSGSGSGTDFTLTISSLQPEDFATYYCQQYYRFPVTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC |
| AF4380 | SEQ ID NO: 180 | EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC |
| | SEQ ID NO: 189 | APTSSSTKKTQLQLEHLLLDLQMILNGINNYKNPKLTDMLTFEFYMPKKATELKHLQCLERELKPLEEVLNLAQSKNFHLRPRDLISNINVIVLELKGSETTFMCEYADETATIVEFLNRWITFCQSIISTLTGGGGSGGGGSGGGGSGGGGSQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK |
| | SEQ ID NO: 190 | QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGSGGGSHHHHHH |

TABLE 23-continued

IgG PD-1/IL-2 PDA with single IL-2, and control protein complexes

| Protein Complex | SEQ ID NO: | Sequence |
|---|---|---|
| AF4383 | SEQ ID NO: 64 | DIQMTQSPSSLSASVGDRVTITCRASQDVNTAVAWYQQKPGKAPK LLIYSASFLYSGVPSRFSGSRSGTDFTLTISSLQPEDFATYYCQQHYT TPPTFGQGTKVEIKRADAAPTVSIFPPSSEQLTSGGASVVCFLNNFY PKDINVKWKIDGSERQNGVLNSWTDQDSKDSTYSMSSTLTLTKDE YERHNSYTCEATHKTSTSPIVKSFNRNEC |
|  | SEQ ID NO: 191 | APTSSSTKKTQLQLEHLLLDLQMILNGINNYKNPKLTDMLTFEFYMPKKATELKHLQ CLERELKPLEEVLNLAQSKNFHLRPRDLISNINVIVLELKGSETTFMCEYADETATIVE FLNRWITFCQSIISTLTGGGGSGGGGSGGGGSGGGGSEVQLVESGGGLVQPGGSL RLSCAASGFNIKDTYIHWVRQAPGKGLEWVARIYPTNGYTRYADSVKGRFTISADT SKNTAYLQMNSLRAEDTAVYYCSRWGGDGFYAMDYWGQGTLVTVSSAKTTAPS VYPLAPVCGDTTGSSVTLGCLVKGYFPEPVTLTWNSGSLSSGVHTFPAVLQSDLYTL SSSVTVTSSTWPSQSITCNVAHPASSTKVDKKIEPRGPTIKPCPPCKCPAPNAAGGP SVFIFPPKIKDVLMISLSPIVTCVVVDVSEDDPDVQISWFVNNVEVHTAQTQTHRED YNSTLRVVSALPIQHQDWMSGKEFKCKVNNKDLGAPIERTISKPKGSVRAPQVYVL PPPEEEMTKKQVTLTCMVTDFMPEDIYVEWTNNGKTELNYKNTEPVLDSDGSYF MYSDLRVEKKNWVERNSYSCSVVHEGLHNHHTTESFSRTPGK |
|  | SEQ ID NO: 192 | EVQLVESGGGLVQPGGSLRLSCAASGFNIKDTYIHWVRQAPGKGLEWVARIYPTNGYTRY ADSVKGRFTISADTSKNTAYLQMNSLRAEDTAVYYCSRWGGDGFYAMDYWGQGTLVTVS SAKTTAPSVYPLAPVCGDTTGSSVTLGCLVKGYFPEPVTLTWNSGSLSSGVHTFPAVLQSDL YTLSSSVTVTSSTWPSQSITCNVAHPASSTKVDKKIEPRGPTIKPCPPCKCPAPNAAGGPSVF IFPPKIKDVLMISLSPIVTCVVVDVSEDDPDVQSWFVNNVEVHTAQTQTHREDYNSTLRVV SALPIQHQDWMSGKEFKCKVNNKDLGAPIERTISKPKGSVRAPQVYVLPPPEKEMTKKQV SLTCLVKDFMPEDIYVEWTNNGKTELNYKNTEPVLKSDGSYFMYSKLTVEKKNWVERNSYS CSVVHEGLHNHHTTKSFSRTPGGGGSGGGSHHHHHH |
| AF4384 | SEQ ID NO: 178 | DIQMTQSPSSLSASVGDRVSITCKASQNVGTNVGWYQQKPGKAPKALIYSASFRYS GVPSRFSGSGSGTDFTLTISSLQPEDFATYFCQQYYTYPYTFGGGTKLEIKRADAAPT VSIFPPSSEQLTSGGASVVCFLNNFYPKDINVKWKIDGSERQNGVLNSWTDQDSK DSTYSMSSTLTLTKDEYERHNSYTCEATHKTSTSPIVKSFNRNEC |
|  | SEQ ID NO: 193 | APTSSSTKKTQLQLEHLLLDLQMILNGINNYKNPKLTDMLTFEFYMPKKATELKHLQ CLERELKPLEEVLNLAQSKNFHLRPRDLISNINVIVLELKGSETTFMCEYADETATIVE FLNRWITFCQSIISTLTGGGGSGGGGSGGGGSGGGGSEVQLVESGGGLVKPGGSL RLSCAASGFTFSSYTLAWVRQAPGKGLEWVAAIDSSSYTYSPDTVRGRFTISRDNAK NSLYLQMNSLRAEDTAVYYCARDSNWDALDYWGQGTLVTVSSAKTTAPSVYPLA PVCGDTTGSSVTLGCLVKGYFPEPVTLTWNSGSLSSGVHTFPAVLQSDLYTLSSSVT VTSSTWPSQSITCNVAHPASSTKVDKKIEPRGPTIKPCPPCKCPAPNAAGGPSVFIFP PKIKDVLMISLSPIVTCVVVDVSEDDPDVQISWFVNNVEVHTAQTQTHREDYNSTL RVVSALPIQHQDWMSGKEFKCKVNNKDLGAPIERTISKPKGSVRAPQVYVLPPPEE EMTKKQVTLTCMVTDFMPEDIYVEWTNNGKTELNYKNTEPVLDSDGSYFMYSDL RVEKKNWVERNSYSCSVVHEGLHNHHTTESFSRTPGK |
|  | SEQ ID NO: 194 | EVQLVESGGGLVKPGGSLRLSCAASGFTFSSYTLAWVRQAPGKGLEWVAAIDSSSY TYSPDTVRGRFTISRDNAKNSLYLQMNSLRAEDTAVYYCARDSNWDALDYWGQG TLVTVSSAKTTAPSVYPLAPVCGDTTGSSVTLGCLVKGYFPEPVTLTWNSGSLSSGV HTFPAVLQSDLYTLSSSVTVTSSTWPSQSITCNVAHPASSTKVDKKIEPRGPTIKPCP PCKCPAPNAAGGPSVFIFPPKIKDVLMISLSPIVTCVVVDVSEDDPDVQISWFVNNV EVHTAQTQTHREDYNSTLRVVSALPIQHQDWMSGKEFKCKVNNKDLGAPIERTIS KPKGSVRAPQVYVLPPPEKEMTKKQVSLTCLVKDFMPEDIYVEWTNNGKTELNYK NTEPVLKSDGSYFMYSKLTVEKKNWVERNSYSCSVVHEGLHNHHTTKSFSRTPGG GGSGGGSHHHHHH |

Figures 17E, 17F:
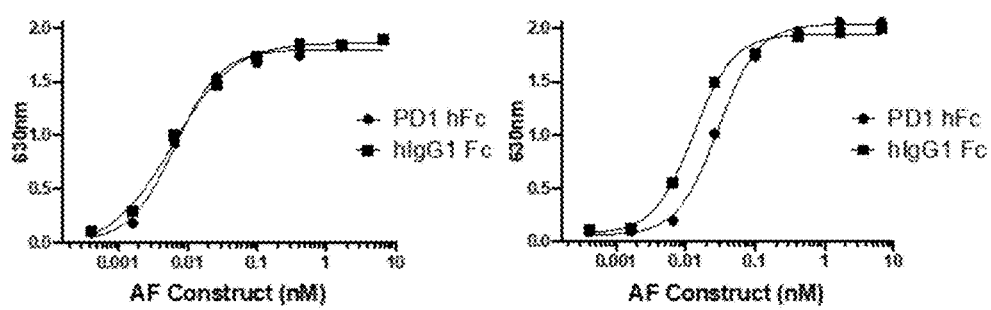
Figures 17G, 17H:
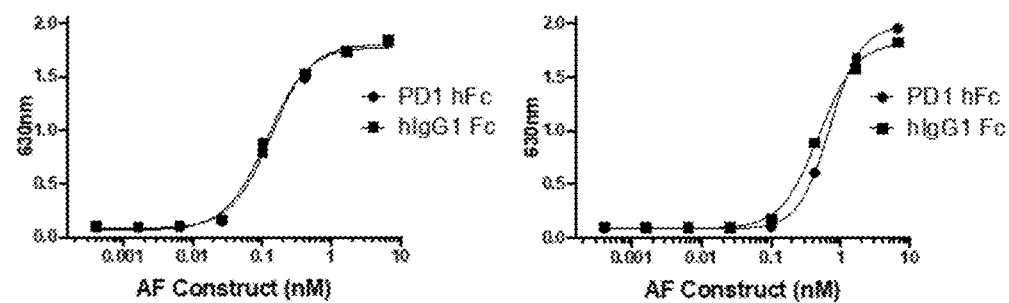

Results with protein complexes comprising the structures depicted in FIG. 14C are shown in FIGS. 17A-H. As depicted in FIG. 14C, these complexes are asymmetric and comprised of two identical monospecific Fab arms with a single IL-2 attached to one Fc domain by flexible linker and a single scFv attached to the other Fc domain by a flexible linker. The active PD-1/IL-2 DBA complexes, AF4403 comprising SEQ ID NO: 180, 195, 199 and AF4404 comprising SEQ ID NO: 180, 196, 199, are composed of anti-PD-1 domains in the Fab arms and a PD-1/IL-2 DBA scFv on the Fc arm. The control antibody-cytokine complexes are composed of a) antibody-cytokine complexes with an irrelevant antibody on the Fab arms with the DBA scFv on the Fc (AF4395 comprising SEQ ID NO: 64, 197, 202 and AF4396 comprising SEQ ID NO: 64, 198, 202), b) antibody-cytokine complexes with a non-DBA scFv on the Fc arm (AF4400 comprising SEQ ID NO: 180, 199-200 and AF4401 comprising SEQ ID NO: 180, 199, 201), and c) antibody-cytokine complexes with non-DBA antibodies in both the Fab and scFv domains (AF4392 comprising SEQ ID NO: 64, 202-203 and AF4393 comprising SEQ ID NO: 64, 202, 204). As shown in FIGS. 17B and 17D, the IL-2 activity of the DBA-cytokine complexes AF4403 and AF4404 had an EC50 of 31 pM and 26 pM respectively in the PD-1 coated wells and 62 pM and 64 pM respectively in the control wells, demonstrating PD-1 dependence of the IL-2 activity. None of the control proteins AF4395, AF4396, AF4400, AF4401, AF4392 and AF4393 described above showed a lower EC50 on PD-1 coated wells than on wells coated with the IgG1 protein, as shown in FIGS. 17A, 17C and 17E-H. Sequences of the protein complexes are summarized in TABLE 24 below.

TABLE 24

IgG PD-1 with C-terminal scFv and IL-2, and control protein complexes

| Protein Complex | SEQ ID NO: | Sequence |
|---|---|---|
| AF4403 | SEQ ID NO: 180 | EIVLTQSPATLSLSPGERATLSCRASQSVSSYLAWYQQKPGQAPRLL IYDASNRATGIPARFSGSGSGTDFTLTISSLEPEDFAVYYCQQSSNW PRTFGQGTKVEIKRADAAPTVSIFPPSSEQLTSGGASVVCFLNNFYP KDINVKWKIDGSERQNGVLNSWTDQDSKDSTYSMSSTLTLTKDEY ERHNSYTCEATHKTSTSPIVKSFNRNEC |
| | SEQ ID NO: 195 | QVQLVESGGGVVQPGRSLRLDCKASGITFSNSGMHWVRQAPGKG LEWVAVIWYDGSKRYYADSVKGRFTISRDNSKNTLFLQMNSLRAE DTAVYYCATNDDYWGQGTLVTVSSAKTTAPSVYPLAPVCGDTTG SSVTLGCLVKGYFPEPVTLTWNSGSLSSGVHTFPAVLQSDLYTLSSS VTVTSSTWPSQSITCNVAHPASSTKVDKKIEPRGPTIKPCPPCKCPAP NAAGGPSVFIFPPKIKDVLMISLSPIVTCVVVDVSEDDPDVQISWFV NNVEVHTAQTQTHREDYNSTLRVVSALPIQHQDWMSGKEFKCKV NNKDLGAPIERTISKPKGSVRAPQVYVLPPPEKEMTKKQVSLTCLV KDFMPEDIYVEWTNNGKTELNYKNTEPVLKSDGSYFMYSKLTVEK KNWVERNSYSCSVVHEGLHNHHTTKSFSRTPGGGGSGGGGSGG GGSGGGGSQVQLVQSGAEVKKPGASVKVSCKASGDTFTRYYVHW VRQAPGQGLEWMGIINPSGGYASYAQKFQGRVTMTRDTSTSTVY MELSSLRSEDTAVYYCAAGLFIWGQGTLVTVSSASGGGGSGGGGS GGGGSHASDIQMTQSPSSLSASVGDRVTITCRASQSIGRYLAWYQQ KPGKAPKLLIYSASNLETGVPSRFSGSGSGTDFTLTISSLQPEDFATY YCQQYNSFPVTFGPGTKVDIKGGGSGGGSHHHHHH |
| | SEQ ID NO: 199 | QVQLVESGGGVVQPGRSLRLDCKASGITFSNSGMHWVRQAPGKG LEWVAVIWYDGSKRYYADSVKGRFTISRDNSKNTLFLQMNSLRAE DTAVYYCATNDDYWGQGTLVTVSSAKTTAPSVYPLAPVCGDTTG SSVTLGCLVKGYFPEPVTLTWNSGSLSSGVHTFPAVLQSDLYTLSSS VTVTSSTWPSQSITCNVAHPASSTKVDKKIEPRGPTIKPCPPCKCPAP NAAGGPSVFIFPPKIKDVLMISLSPIVTCVVVDVSEDDPDVQISWFV NNVEVHTAQTQTHREDYNSTLRVVSALPIQHQDWMSGKEFKCKV NNKDLGAPIERTISKPKGSVRAPQVYVLPPPEEEMTKKQVTLTCMV TDFMPEDIYVEWTNNGKTELNYKNTEPVLDSDGSYFMYSDLRVEK KNWVERNSYSCSVVHEGLHNHHTTESFSRTPGGGGSGGGGSGG GGSAPTSSSTKKTQLQLEHLLLDLQMILNGINNYKNPKLTDMLTFE FYMPKKATELKHLQCLERELKPLEEVLNLAQSKNFHLRPRDLISNI NVIVLELKGSETTFMCEYADETATIVEFLNRWITFCQSIISTLT |
| AF4404 | SEQ ID NO: 180 | EIVLTQSPATLSLSPGERATLSCRASQSVSSYLAWYQQKPGQAPRLL IYDASNRATGIPARFSGSGSGTDFTLTISSLEPEDFAVYYCQQSSNW PRTFGQGTKVEIKRADAAPTVSIFPPSSEQLTSGGASVVCFLNNFYP KDINVKWKIDGSERQNGVLNSWTDQDSKDSTYSMSSTLTLTKDEY ERHNSYTCEATHKTSTSPIVKSFNRNEC |
| | SEQ ID NO: 196 | QVQLVESGGGVVQPGRSLRLDCKASGITFSNSGMHWVRQAPGKG LEWVAVIWYDGSKRYYADSVKGRFTISRDNSKNTLFLQMNSLRAE DTAVYYCATNDDYWGQGTLVTVSSAKTTAPSVYPLAPVCGDTTG SSVTLGCLVKGYFPEPVTLTWNSGSLSSGVHTFPAVLQSDLYTLSSS VTVTSSTWPSQSITCNVAHPASSTKVDKKIEPRGPTIKPCPPCKCPAP NAAGGPSVFIFPPKIKDVLMISLSPIVTCVVVDVSEDDPDVQISWFV NNVEVHTAQTQTHREDYNSTLRVVSALPIQHQDWMSGKEFKCKV NNKDLGAPIERTISKPKGSVRAPQVYVLPPPEKEMTKKQVSLTCLV KDFMPEDIYVEWTNNGKTELNYKNTEPVLKSDGSYFMYSKLTVEK KNWVERNSYSCSVVHEGLHNHHTTKSFSRTPGGGGSGGGGSGG GGSGGGGSQVQLVQSGAEVKKPGASVKVSCKASGYTFTDYYMH WVRQAPGQGLEWMGIINPRAGYTSYALKFQGRVTMTRDTSTSTV YMELSSLRSEDTAVYYCTSGWDVWGQGTLVTVSSASGGGGSGGG GSGGGGSHASDIQMTQSPSSLSASVGDRVTITCRASQSISTWLAWY QQKPGKAPKLLIYAASSLDSGVPSRFSGSGSGTDFTLTISSLQPEDFA TYYCQQSYSFPVTFGQGTKVEIKGGGSGGGSHHHHHH |
| | SEQ ID NO: 199 | QVQLVESGGGVVQPGRSLRLDCKASGITFSNSGMHWVRQAPGKG LEWVAVIWYDGSKRYYADSVKGRFTISRDNSKNTLFLQMNSLRAE DTAVYYCATNDDYWGQGTLVTVSSAKTTAPSVYPLAPVCGDTTG SSVTLGCLVKGYFPEPVTLTWNSGSLSSGVHTFPAVLQSDLYTLSSS VTVTSSTWPSQSITCNVAHPASSTKVDKKIEPRGPTIKPCPPCKCPAP NAAGGPSVFIFPPKIKDVLMISLSPIVTCVVVDVSEDDPDVQISWFV NNVEVHTAQTQTHREDYNSTLRVVSALPIQHQDWMSGKEFKCKV NNKDLGAPIERTISKPKGSVRAPQVYVLPPPEEEMTKKQVTLTCMV TDFMPEDIYVEWTNNGKTELNYKNTEPVLDSDGSYFMYSDLRVEK KNWVERNSYSCSVVHEGLHNHHTTESFSRTPGGGGSGGGGSGG GGSAPTSSSTKKTQLQLEHLLLDLQMILNGINNYKNPKLTDMLTFE FYMPKKATELKHLQCLERELKPLEEVLNLAQSKNFHLRPRDLISNI NVIVLELKGSETTFMCEYADETATIVEFLNRWITFCQSIISTLT |

TABLE 24-continued

IgG PD-1 with C-terminal scFv and IL-2, and control protein complexes

| Protein Complex | SEQ ID NO: | Sequence |
|---|---|---|
| AF4395 | SEQ ID NO: 64 | DIQMTQSPSSLSASVGDRVTITCRASQDVNTAVAWYQQKPGKAPK LLIYSASFLYSGVPSRFSGSRSGTDFTLTISSLQPEDFATYYCQQHYT TPPTFGQGTKVEIKRADAAPTVSIFPPSSEQLTSGGASVVCFLNNFY PKDINVKWKIDGSERQNGVLNSWTDQDSKDSTYSMSSTLTLTKDE YERHNSYTCEATHKTSTSPIVKSFNRNEC |
|  | SEQ ID NO: 197 | EVQLVESGGGLVQPGGSLRLSCAASGFNIKDTYIHWVRQAPGKGL EWVARIYPTNGYTRYADSVKGRFTISADTSKNTAYLQMNSLRAED TAVYYCSRWGGDGFYAMDYWGQGTLVTVSSAKTTAPSVYPLAPV CGDTTGSSVTLGCLVKGYFPEPVTLTWNSGSLSSGVHTFPAVLQSD LYTLSSSVTVTSSTWPSQSITCNVAHPASSTKVDKKIEPRGPTIKPCP PCKCPAPNAAGGPSVFIFPPKIKDVLMISLSPIVTCVVVDVSEDDPD VQISWFVNNVEVHTAQTQTHREDYNSTLRVVSALPIQHQDWMSG KEFKCKVNNKDLGAPIERTISKPKGSVRAPQVYVLPPPEKEMTKKQ VSLTCLVKDFMPEDIYVEWTNNGKTELNYKNTEPVLKSDGSYFMY SKLTVEKKNWVERNSYSCSVVHEGLHNHHTTKSFSRTPGGGGGSG GGGSGGGGSGGGGSQVQLVQSGAEVKKPGASVKVSCKASGDTFT RYYVHWVRQAPGQGLEWMGIINPSGGYASYAQKFQGRVTMTRDT STSTVYMELSSLRSEDTAVYYCAAGLFIWGQGTLVTVSSASGGGGS GGGGSGGGGSHASDIQMTQSPSSLSASVGDRVTITCRASQSIGRYL AWYQQKPGKAPKLLIYSASNLETGVPSRFSGSGSGTDFTLTISSLQP EDFATYYCQQYNSFPVTFGPGTKVDIKGGGSGGGSHHHHHH |
|  | SEQ ID NO: 202 | EVQLVESGGGLVQPGGSLRLSCAASGFNIKDTYIHWVRQAPGKGL EWVARIYPTNGYTRYADSVKGRFTISADTSKNTAYLQMNSLRAED TAVYYCSRWGGDGFYAMDYWGQGTLVTVSSAKTTAPSVYPLAPV CGDTTGSSVTLGCLVKGYFPEPVTLTWNSGSLSSGVHTFPAVLQSD LYTLSSSVTVTSSTWPSQSITCNVAHPASSTKVDKKIEPRGPTIKPCP PCKCPAPNAAGGPSVFIFPPKIKDVLMISLSPIVTCVVVDVSEDDPD VQISWFVNNVEVHTAQTQTHREDYNSTLRVVSALPIQHQDWMSG KEFKCKVNNKDLGAPIERTISKPKGSVRAPQVYVLPPPEEEMTKKQ VTLTCMVTDFMPEDIYVEWTNNGKTELNYKNTEPVLDSDGSYFM YSDLRVEKKNWVERNSYSCSVVHEGLHNHHTTESFSRTPGGGGGS GGGGSGGGGSAPTSSSTKKTQLQLEHLLLDLQMILNGINNYKNPKL TDMLTFEFYMPKKATELKHLQCLERELKPLEEVLNLAQSKNFHLRP RDLISNINIVIVLELKGSETTFMCEYADETATIVEFLNRWITFCQSIIST LT |
| AF4396 | SEQ ID NO: 64 | DIQMTQSPSSLSASVGDRVTITCRASQDVNTAVAWYQQKPGKAPK LLIYSASFLYSGVPSRFSGSRSGTDFTLTISSLQPEDFATYYCQQHYT TPPTFGQGTKVEIKRADAAPTVSIFPPSSEQLTSGGASVVCFLNNFY PKDINVKWKIDGSERQNGVLNSWTDQDSKDSTYSMSSTLTLTKDE YERHNSYTCEATHKTSTSPIVKSFNRNEC |
|  | SEQ ID NO: 198 | EVQLVESGGGLVQPGGSLRLSCAASGFNIKDTYIHWVRQAPGKGL EWVARIYPTNGYTRYADSVKGRFTISADTSKNTAYLQMNSLRAED TAVYYCSRWGGDGFYAMDYWGQGTLVTVSSAKTTAPSVYPLAPV CGDTTGSSVTLGCLVKGYFPEPVTLTWNSGSLSSGVHTFPAVLQSD LYTLSSSVTVTSSTWPSQSITCNVAHPASSTKVDKKIEPRGPTIKPCP PCKCPAPNAAGGPSVFIFPPKIKDVLMISLSPIVTCVVVDVSEDDPD VQISWFVNNVEVHTAQTQTHREDYNSTLRVVSALPIQHQDWMSG KEFKCKVNNKDLGAPIERTISKPKGSVRAPQVYVLPPPEKEMTKKQ VSLTCLVKDFMPEDIYVEWTNNGKTELNYKNTEPVLKSDGSYFMY SKLTVEKKNWVERNSYSCSVVHEGLHNHHTTKSFSRTPGGGGGSG GGGSGGGGSGGGGSQVQLVQSGAEVKKPGASVKVSCKASGYTFT DYYMHWVRQAPGQGLEWMGIINPRAGYTSYALKFQGRVTMTRD TSTSTVYMELSSLRSEDTAVYYCTSGWDVWGQGTLVTVSSASGGG GSGGGGSGGGGSHASDIQMTQSPSSLSASVGDRVTITCRASQSIST WLAWYQQKPGKAPKLLIYAASSLDSGVPSRFSGSGSGTDFTLTISSL QPEDFATYYCQQSYSFPVTFGQGTKVEIKGGGSGGGSHHHHHH |
|  | SEQ ID NO: 202 | EVQLVESGGGLVQPGGSLRLSCAASGFNIKDTYIHWVRQAPGKGL EWVARIYPTNGYTRYADSVKGRFTISADTSKNTAYLQMNSLRAED TAVYYCSRWGGDGFYAMDYWGQGTLVTVSSAKTTAPSVYPLAPV CGDTTGSSVTLGCLVKGYFPEPVTLTWNSGSLSSGVHTFPAVLQSD LYTLSSSVTVTSSTWPSQSITCNVAHPASSTKVDKKIEPRGPTIKPCP PCKCPAPNAAGGPSVFIFPPKIKDVLMISLSPIVTCVVVDVSEDDPD VQISWFVNNVEVHTAQTQTHREDYNSTLRVVSALPIQHQDWMSG KEFKCKVNNKDLGAPIERTISKPKGSVRAPQVYVLPPPEEEMTKKQ VTLTCMVTDFMPEDIYVEWTNNGKTELNYKNTEPVLDSDGSYFM YSDLRVEKKNWVERNSYSCSVVHEGLHNHHTTESFSRTPGGGGGS GGGGSGGGGSAPTSSSTKKTQLQLEHLLLDLQMILNGINNYKNPKL TDMLTFEFYMPKKATELKHLQCLERELKPLEEVLNLAQSKNFHLRP RDLISNINIVIVLELKGSETTFMCEYADETATIVEFLNRWITFCQSIIST LT |

TABLE 24-continued

IgG PD-1 with C-terminal scFv and IL-2, and control protein complexes

| Protein Complex | SEQ ID NO: | Sequence |
|---|---|---|
| AF4400 | SEQ ID NO: 180 | EIVLTQSPATLSLSPGERATLSCRASQSVSSYLAWYQQKPGQAPRLL IYDASNRATGIPARFSGSGSGTDFTLTISSLEPEDFAVYYCQQSSNW PRTFGQGTKVEIKRADAAPTVSIFPPSSEQLTSGGASVVCFLNNFYP KDINVKWKIDGSERQNGVLNSWTDQDSKDSTYSMSSTLTLTKDEY ERHNSYTCEATHKTSTSPIVKSFNRNEC |
| | SEQ ID NO: 199 | QVQLVESGGGVVQPGRSLRLDCKASGITFSNSGMHWVRQAPGKG LEWVAVIWYDGSKRYYADSVKGRFTISRDNSKNTLFLQMNSLRAE DTAVYYCATNDDYWGQGTLVTVSSAKTTAPSVYPLAPVCGDTTG SSVTLGCLVKGYFPEPVTLTWNSGSLSSGVHTFPAVLQSDLYTLSSS VTVTSSTWPSQSITCNVAHPASSTKVDKKIEPRGPTIKPCPPCKCPAP NAAGGPSVFIFPPKIKDVLMISLSPIVTCVVVDVSEDDPDVQISWFV NNVEVHTAQTQTHREDYNSTLRVVSALPIQHQDWMSGKEFKCKV NNKDLGAPIERTISKPKGSVRAPQVYVLPPPEEEMTKKQVTLTCMV TDFMPEDIYVEWTNNGKTELNYKNTEPVLDSDGSYFMYSDLRVEK KNWVERNSYSCSVVHEGLHNHHTTESFSRTPGGGGSGGGGSGG GGSAPTSSSTKKTQLQLEHLLLDLQMILNGINNYKNPKLTDMLTFE FYMPKKATELKHLQCLERELKPLEEVLNLAQSKNFHLRPRDLISNI NVIVLELKGSETTFMCEYADETATIVEFLNRWITFCQSIISTLT |
| | SEQ ID NO: 200 | QVQLVESGGGVVQPGRSLRLDCKASGITFSNSGMHWVRQAPGKG LEWVAVIWYDGSKRYYADSVKGRFTISRDNSKNTLFLQMNSLRAE DTAVYYCATNDDYWGQGTLVTVSSAKTTAPSVYPLAPVCGDTTG SSVTLGCLVKGYFPEPVTLTWNSGSLSSGVHTFPAVLQSDLYTLSSS VTVTSSTWPSQSITCNVAHPASSTKVDKKIEPRGPTIKPCPPCKCPAP NAAGGPSVFIFPPKIKDVLMISLSPIVTCVVVDVSEDDPDVQISWFV NNVEVHTAQTQTHREDYNSTLRVVSALPIQHQDWMSGKEFKCKV NNKDLGAPIERTISKPKGSVRAPQVYVLPPPEKEMTKKQVSLTCLV KDFMPEDIYVEWTNNGKTELNYKNTEPVLKSDGSYFMYSKLTVEK KNWVERNSYSCSVVHEGLHNHHTTKSFSRTPGGGGSGGGGSGG GGSGGGGSEVQLVESGGGLVQPGGSLRLSCAASGFNIKDTYIHWV RQAPGKGLEWVARIYPTNGYTRYADSVKGRFTISADTSKNTAYLQ MNSLRAEDTAVYYCSRWGGDGFYAMDYWGQGTLVTVSSASGGG GSGGGGSGGGGSHASDIQMTQSPSSLSASVGDRVTITCRASQDVNT AVAWYQQKPGKAPKLLIYSASFLYSGVPSRFSGSRSGTDFTLTISSL QPEDFATYYCQQHYTTPPTFGQGTKVEIKGGGSGGGSHHHHHH |
| AF4401 | SEQ ID NO: 180 | EIVLTQSPATLSLSPGERATLSCRASQSVSSYLAWYQQKPGQAPRLL IYDASNRATGIPARFSGSGSGTDFTLTISSLEPEDFAVYYCQQSSNW PRTFGQGTKVEIKRADAAPTVSIFPPSSEQLTSGGASVVCFLNNFYP KDINVKWKIDGSERQNGVLNSWTDQDSKDSTYSMSSTLTLTKDEY ERHNSYTCEATHKTSTSPIVKSFNRNEC |
| | SEQ ID NO: 199 | QVQLVESGGGVVQPGRSLRLDCKASGITFSNSGMHWVRQAPGKG LEWVAVIWYDGSKRYYADSVKGRFTISRDNSKNTLFLQMNSLRAE DTAVYYCATNDDYWGQGTLVTVSSAKTTAPSVYPLAPVCGDTTG SSVTLGCLVKGYFPEPVTLTWNSGSLSSGVHTFPAVLQSDLYTLSSS VTVTSSTWPSQSITCNVAHPASSTKVDKKIEPRGPTIKPCPPCKCPAP NAAGGPSVFIFPPKIKDVLMISLSPIVTCVVVDVSEDDPDVQISWFV NNVEVHTAQTQTHREDYNSTLRVVSALPIQHQDWMSGKEFKCKV NNKDLGAPIERTISKPKGSVRAPQVYVLPPPEEEMTKKQVTLTCMV TDFMPEDIYVEWTNNGKTELNYKNTEPVLDSDGSYFMYSDLRVEK KNWVERNSYSCSVVHEGLHNHHTTESFSRTPGGGGSGGGGSGG GGSAPTSSSTKKTQLQLEHLLLDLQMILNGINNYKNPKLTDMLTFE FYMPKKATELKHLQCLERELKPLEEVLNLAQSKNFHLRPRDLISNI NVIVLELKGSETTFMCEYADETATIVEFLNRWITFCQSIISTLT |
| | SEQ ID NO: 201 | QVQLVESGGGVVQPGRSLRLDCKASGITFSNSGMHWVRQAPGKG LEWVAVIWYDGSKRYYADSVKGRFTISRDNSKNTLFLQMNSLRAE DTAVYYCATNDDYWGQGTLVTVSSAKTTAPSVYPLAPVCGDTTG SSVTLGCLVKGYFPEPVTLTWNSGSLSSGVHTFPAVLQSDLYTLSSS VTVTSSTWPSQSITCNVAHPASSTKVDKKIEPRGPTIKPCPPCKCPAP NAAGGPSVFIFPPKIKDVLMISLSPIVTCVVVDVSEDDPDVQISWFV NNVEVHTAQTQTHREDYNSTLRVVSALPIQHQDWMSGKEFKCKV NNKDLGAPIERTISKPKGSVRAPQVYVLPPPEKEMTKKQVSLTCLV KDFMPEDIYVEWTNNGKTELNYKNTEPVLKSDGSYFMYSKLTVEK KNWVERNSYSCSVVHEGLHNHHTTKSFSRTPGGGGSGGGGSGG GGSGGGGSEVQLVESGGGLVKPGGSLRLSCAASGFTFSSYTLAWV RQAPGKGLEWVAAIDSSSYTYSPDTVRGRFTISRDNAKNSLYLQM NSLRAEDTAVYYCARDSNWDALDYWGQGTLVTVSSASGGGGSG GGSGGGGSHASDIQMTQSPSSLSASVGDRVSITCKASQNVGTNVG WYQQKPGKAPKALIYSASFRYGVPSRFSGSGSGTDFTLTISSLQPE DFATYFCQQYYTYPYTFGGGTKLEIKGGGSGGGSHHHHHH |

TABLE 24-continued

IgG PD-1 with C-terminal scFv and IL-2, and control protein complexes

| Protein Complex | SEQ ID NO: | Sequence |
|---|---|---|
| AF4392 | SEQ ID NO: 64 | DIQMTQSPSSLSASVGDRVTITCRASQDVNTAVAWYQQKPGKAPK LLIYSASFLYSGVPSRFSGSRSGTDFTLTISSLQPEDFATYYCQQHYT TPPTFGQGTKVEIKRADAAPTVSIFPPSSEQLTSGGASVVCFLNNFY PKDINVKWKIDGSERQNGVLNSWTDQDSKDSTYSMSSTLTLTKDE YERHNSYTCEATHKTSTSPIVKSFNRNEC |
|  | SEQ ID NO: 202 | EVQLVESGGGLVQPGGSLRLSCAASGFNIKDTYIHWVRQAPGKGL EWVARIYPTNGYTRYADSVKGRFTISADTSKNTAYLQMNSLRAED TAVYYCSRWGGDGFYAMDYWGQGTLVTVSSAKTTAPSVYPLAPV CGDTTGSSVTLGCLVKGYFPEPVTLTWNSGSLSSGVHTFPAVLQSD LYTLSSSVTVTSSTWPSQSITCNVAHPASSTKVDKKIEPRGPTIKPCP PCKCPAPNAAGGPSVFIFPPKIDVLMISLSPIVTCVVVDVSEDDPD VQISWFVNNVEVHTAQTQTHREDYNSTLRVVSALPIQHQDWMSG KEFKCKVNNKDLGAPIERTISKPKGSVRAPQVYVLPPPEEEMTKKQ VTLTCMVTDFMPEDIYVEWTNNGKTELNYKNTEPVLDSDGSYFM YSDLRVEKKNWVERNSYSCSVVHEGLHNHHTTESFSRTPGGGGGS GGGGSGGGGSAPTSSSTKKTQLQLEHLLLDLQMILNGINNYKNPKL TDMLTFEFYMPKKATELKHLQCLERELKPLEEVLNLAQSKNFHLRP RDLISNINIVIVLELKGSETTFMCEYADETATIVEFLNRWITFCQSIIST LT |
|  | SEQ ID NO: 203 | EVQLVESGGGLVQPGGSLRLSCAASGFNIKDTYIHWVRQAPGKGL EWVARIYPTNGYTRYADSVKGRFTISADTSKNTAYLQMNSLRAED TAVYYCSRWGGDGFYAMDYWGQGTLVTVSSAKTTAPSVYPLAPV CGDTTGSSVTLGCLVKGYFPEPVTLTWNSGSLSSGVHTFPAVLQSD LYTLSSSVTVTSSTWPSQSITCNVAHPASSTKVDKKIEPRGPTIKPCP PCKCPAPNAAGGPSVFIFPPKIDVLMISLSPIVTCVVVDVSEDDPD VQISWFVNNVEVHTAQTQTHREDYNSTLRVVSALPIQHQDWMSG KEFKCKVNNKDLGAPIERTISKPKGSVRAPQVYVLPPPEEKMTKKQ VSLTCLVKDFMPEDIYVEWTNNGKTELNYKNTEPVLKSDGSYFMY SKLTVEKKNWVERNSYSCSVVHEGLHNHHTTKSFSRTPGGGGSG GGGSGGGGSGGGGSEVQLVESGGGLVQPGGSLRLSCAASGFNIKD TYIHWVRQAPGKGLEWVARIYPTNGYTRYADSVKGRFTISADTSK NTAYLQMNSLRAEDTAVYYCSRWGGDGFYAMDYWGQGTLVTVS SASGGGGSGGGGSGGGGSHASDIQMTQSPSSLSASVGDRVTITCRA SQDVNTAVAWYQQKPGKAPKLLIYSASFLYSGVPSRFSGSRSGTDF TLTISSLQPEDFATYYCQQHYTTPPTFGQGTKVEIKGGGSGGGSHH HHHH |
| AF4393 | SEQ ID NO: 64 | DIQMTQSPSSLSASVGDRVTITCRASQDVNTAVAWYQQKPGKAPK LLIYSASFLYSGVPSRFSGSRSGTDFTLTISSLQPEDFATYYCQQHYT TPPTFGQGTKVEIKRADAAPTVSIFPPSSEQLTSGGASVVCFLNNFY PKDINVKWKIDGSERQNGVLNSWTDQDSKDSTYSMSSTLTLTKDE YERHNSYTCEATHKTSTSPIVKSFNRNEC |
|  | SEQ ID NO: 202 | EVQLVESGGGLVQPGGSLRLSCAASGFNIKDTYIHWVRQAPGKGL EWVARIYPTNGYTRYADSVKGRFTISADTSKNTAYLQMNSLRAED TAVYYCSRWGGDGFYAMDYWGQGTLVTVSSAKTTAPSVYPLAPV CGDTTGSSVTLGCLVKGYFPEPVTLTWNSGSLSSGVHTFPAVLQSD LYTLSSSVTVTSSTWPSQSITCNVAHPASSTKVDKKIEPRGPTIKPCP PCKCPAPNAAGGPSVFIFPPKIDVLMISLSPIVTCVVVDVSEDDPD VQISWFVNNVEVHTAQTQTHREDYNSTLRVVSALPIQHQDWMSG KEFKCKVNNKDLGAPIERTISKPKGSVRAPQVYVLPPPEEEMTKKQ VTLTCMVTDFMPEDIYVEWTNNGKTELNYKNTEPVLDSDGSYFM YSDLRVEKKNWVERNSYSCSVVHEGLHNHHTTESFSRTPGGGGGS GGGGSGGGGSAPTSSSTKKTQLQLEHLLLDLQMILNGINNYKNPKL TDMLTFEFYMPKKATELKHLQCLERELKPLEEVLNLAQSKNFHLRP RDLISNINIVIVLELKGSETTFMCEYADETATIVEFLNRWITFCQSIIST LT |
|  | SEQ ID NO: 204 | EVQLVESGGGLVQPGGSLRLSCAASGFNIKDTYIHWVRQAPGKGL EWVARIYPTNGYTRYADSVKGRFTISADTSKNTAYLQMNSLRAED TAVYYCSRWGGDGFYAMDYWGQGTLVTVSSAKTTAPSVYPLAPV CGDTTGSSVTLGCLVKGYFPEPVTLTWNSGSLSSGVHTFPAVLQSD LYTLSSSVTVTSSTWPSQSITCNVAHPASSTKVDKKIEPRGPTIKPCP PCKCPAPNAAGGPSVFIFPPKIDVLMISLSPIVTCVVVDVSEDDPD VQISWFVNNVEVHTAQTQTHREDYNSTLRVVSALPIQHQDWMSG KEFKCKVNNKDLGAPIERTISKPKGSVRAPQVYVLPPPEEKMTKKQ VSLTCLVKDFMPEDIYVEWTNNGKTELNYKNTEPVLKSDGSYFMY SKLTVEKKNWVERNSYSCSVVHEGLHNHHTTKSFSRTPGGGGSG GGGSGGGGSGGGGSEVQLVESGGGLVKPGGSLRLSCAASGFTFSS YTLAWVRQAPGKGLEWVAAIDSSSYTYSPDTVRGRFTISRDNAKN SLYLQMNSLRAEDTAVYYCARDSNWDALDYWGQGTLVTVSSASG GGGSGGGGSGGGGSHASDIQMTQSPSSLSASVGDRVSITCKASQNV GTNVGWYQQKPGKAPKALIYSASFRYSGVPSRFSGSGSGTDFTLTI SSLQPEDFATYFCQQYYTYPYTFGGGTKLEIKGGGSGGGSHHHHH H |

Example 27

Improved Regulation by Engineering DBA Affinity Using Standard Methods

This example describes the use of standard techniques to modify DBA affinity and improve the range of sensor-dependent activation of a DBA-cytokine construct. A series of variants of the DBA PDL1-IFN R01 A05 (EXAMPLE 1) were prepared as described in EXAMPLE 4, assembled into DBA-cytokine-complexes and assayed as described in EXAMPLE 9. Results with six exemplary variant DBA-cytokine complexes are shown in FIG. 21A-F. Each plot includes data for IFNAR2 binding in the presence (triangles) and absence (squares) of PD-L1. Binding to a control IFNα antibody (circles) is used to confirm the presence of intact DBA-complex and provide a relative estimate of the amount of DBA-complex captured in the wells. AF2719 and the five variant DBA-cytokine complexes show negligible IFNAR2 binding in the absence of PD-L1 and different levels of IFNAR2 binding in the presence of PD-L1. AF3099 (SEQ ID NO: 293) shows negligible IFNAR2 binding at all concentrations of PD-L1, while the IFNAR2 binding signal with AF3092 (SEQ ID NO: 292) is similar to the anti-IFNα antibody binding. AF2719 (SEQ ID NO: 41), AF3101 (SEQ ID NO: 289), AF3093 (SEQ ID NO: 290) and AF3094 (SEQ ID NO: 291) show intermediate levels of IFNAR binding relative to anti-IFNα binding. Together, these results demonstrate that standard methods of antibody engineering may be used to improve the regulation of the therapeutic activity of a DBA-cytokine complex. Protein complex sequences are provided in TABLE 25 below.

TABLE 25

DBA-cytokine protein complexes

| Protein Complex | SEQ ID NO: | Sequence |
|---|---|---|
| AF3099 | SEQ ID NO: 293 | MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGYTFSGYYIHWVRQAPGQGLEWMGWMDSNSGGTGYAQKFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKGKPIPNPLLGLDST |
| AF3092 | SEQ ID NO: 292 | MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGYTFSNYYIHWVRQAPGQGLEWMGWMDPNSGGTGYAQKFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKGKPIPNPLLGLDST |
| AF2719 | SEQ ID NO: 41 | MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGYTFSNYYVHWVRQAPGQGLEWMGWMDPNSGGTGYAHQFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKGKPIPNPLLGLDST |
| AF3101 | SEQ ID NO: 289 | MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGYTFSNYYIHWVRQAPGQGLEWMGWMDGNSGGTGYAQKFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKGKPIPNPLLGLDST |
| AF3093 | SEQ ID NO: 290 | MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGYTFSNYYIHWVRQAPGQGLEWMGWMDSNSGYTGYAQKFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKGKPIPNPLLGLDST |
| AF3094 | SEQ ID NO: 291 | MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGYTFSNYYIH |

TABLE 25-continued

DBA-cytokine protein complexes

| Protein Complex | SEQ ID NO: | Sequence |
|---|---|---|
| | | WVRQAPGQGLEWMGWMDPNSGYTGYAHQFQGRVTMTRDTSTSTVYMELSSL RSEDTAVYYCAKEVFSGWYDYWGQGTLVTVSSASGGGGSGGGGSGGGGSHASDI QMTQSPSSLSASVGDRVTITCRASQSISSYLNWYQQKPGKAPKLLIYAASSLQSGVP SRFSGSGSGTDFTLTISSLQPEDFATYYCQQSYSTPYTFGQGTKVEIKGKPIPNPLLGL DST |

Example 28

Regulated Interferon Receptor Binding by PD-L1/IFNα Dual Binding Antibodies

This example describes regulated interferon receptor binding by PD-L1/IFNα DBA-cytokine complexes. DBA-cytokine complexes AF2659 (SEQ ID NO: 276-277), AF2666 (SEQ ID NO: 96 and 277), AF2645 (SEQ ID NO: 95 and 112), AF2615 (SEQ ID NO: 279-280) and AF2616 (SEQ ID NO: 281-282) were chosen for analysis. The DBAs used to assemble these complexes were derived from three parental PD-L1/IFNα DBAs described in EXAMPLE 1: PDL1-IFN-R01-A05 (AF2659 and AF2666), PDL1-IFN-R01-C08 (AF2645) and PDL1-IFN-R01-B12 (AF2615 and AF2616) using standard antibody engineering techniques as described in EXAMPLE 4. Three control antibody-cytokine constructs were assembled from monospecific antibodies: AF2696 (anti-PDL1, SEQ ID NO: 283-284), AF2697 (anti-Her2, SEQ ID NO: 214 and 286) and AF2698 (anti-IFNα, SEQ ID NO: 287-288). Protein complex sequences are provided in TABLE 26 below. The eight antibody-cytokine complexes were produced as symmetric IgG molecules with IFNα appended to the N-terminus of the heavy chain through a flexible linker (AF2659, AF2666 and AF2645, shown schematically in FIG. 9*e*) or the N-terminus of the light chain through a flexible linker (AF2615, AF2616, AF2696, AF2697 and AF2698, shown schematically in FIG. 9*d*). The proteins were expressed in mammalian cells and purified using standard protocols. An ELISA assay was performed with a constant amount of the antibody-cytokine construct coated on each well probed with biotinylated interferon receptor (IFNAR2) in the presence of varying amounts of PD-L1-Fc or Her2-Fc. 384-well ELISA plates were coated with anti-Fc antibody at 10 micrograms/ml overnight at 4° C. and washed twice with SuperBlock. Twenty microliters of a 66.7 nM antibody-cytokine complex was added to each well, incubated for one hour and washed three times in PBS. Biotinylated IFNAR2 protein was added to each well at a final concentration of 5 nM with PD-L1-Fc protein or HER2-Fc protein at a final concentration of 0.64 nM, 3.2 nM, 16 nM, 80 nM, or 400 nM. The plates were incubated for an hour, washed and biotinylated IFNAR2 detection was performed using streptavidin-HRP and standard ELISA protocols. As shown in FIG. 22A-H, DBA-cytokine complexes AF2659, AF2666, AF2645, AF2615 and AF2616 show a dose-dependent induction of IFNAR2 binding in the presence of PD-L1 protein but were not affected by the same dose range of Her2 protein, demonstrating PD-L1 dependent INF activity in five DBA constructs derived from three different parental PD-L1/IFNA dual-binding antibodies. IFNAR2 binding to the three control antibody complexes AF2696, AF2697 and AF2698 was not significantly affected by PD-L1 concentration. Protein complexes of the present invention can be produced from multiple dual-binding antibodies using standard antibody engineering methods.

TABLE 26

| DBA-cytokine protein complexes | | |
|---|---|---|
| Protein Complex | SEQ ID NO: | Sequence |
| AF2659 | SEQ ID NO: 276 | CDLPQTHSLGSRRTLMLLAQMRRISLFSCLKDRHDFGFPQEEFGNQFQKAETIPVL HEMIQQIFNLFSTKDSSAAWDETLLDKFYTELYQQLNDLEACVIQGVGVTETPLMK EDSILAVRKYFQRITLYLKEKKYSPCAWEVVRAEIMRSFSLSTNLQESLRSKEVPGVG VPGAGVPGVGVPGGGVPGVGVPGGGVPGAGVPGGGVPGVGVPGAGVPGVGV PGGGQVQLVQSGAEVKKPGASVKVSCKASGYTFSNYYIHWVRQAPGQGLEWMG WMDSNSGYTGYAQKFQGRVTMTRDTSTSTVYMELSSLRSEDTAVYYCAKEVFSG WYDYWGQGTLVTVSSAKTTAPSVYPLAPVCGDTTGSSVTLGCLVKGYFPEPVTLT WNSGSLSSGVHTFPAVLQSDLYTLSSSVTVTSSTWPSQSITCNVAHPASSTKVDKKI EPRGPTIKPCPPCKCPAPNAAGGPSVFIFPPKIKDVLMISLSPIVTCVVVDVSEDDPD VQISWFVNNVEVHTAQTQTHREDYNSTLRVVSALPIQHQDWMSGKEFKCKVNN KDLGAPIERTISKPKGSVRAPQVYVLPPPEEEMTKKQVTLTCMVTDFMPEDIYVEW TNNGKTELNYKNTEPVLDSDGSYFMYSKLRVEKKNWVERNSYSCSVVHEGLHNHH TTKSFSRTPGK |
| | SEQ ID NO: 277 | DIQMTQSPSSLSASVGDRVTITCRASQSISSYLNWYQQKPGKAPKLLIYAASSLQSG VPSRFSGSGSGTDFTLTISSLQPEDFATYYCQQSYSTPYTFGQGTKVEIKRADAAPTV SIFPPSSEQLTSGGASVVCFLNNFYPKDINVKWKIDGSERQNGVLNSWTDQDSKDS TYSMSSTLTLTKDEYERHNSYTCEATHKTSTSPIVKSFNRNEC |
| AF2666 | SEQ ID NO: 96 | CDLPQTHSLGSRRTLMLLAQMRRISLFSCLKDRHDFGFPQEEFGNQFQKAETIPVL HEMIQQIFNLFSTKDSSAAWDETLLDKFYTELYQQLNDLEACVIQGVGVTETPLMK EDSILAVRKYFQRITLYLKEKKYSPCAWEVVRAEIMRSFSLSTNLQESLRSKEVPGVG VPGAGVPGVGVPGGGVPGVGVPGGGVPGAGVPGGGVPGVGVPGAGVPGVGV PGGGQVQLVQSGAEVKKPGASVKVSCKASGYTFSNYYIHWVRQAPGQGLEWMG |

TABLE 26-continued

DBA-cytokine protein complexes

| Protein Complex | SEQ ID NO: | Sequence |
|---|---|---|
| | | WMDSNSGYTGYAQQFQGRVTMTRDTSTSTVYMELSSLRSEDTAVYYCAKEVFSG WYDYWGQGTLVTVSSAKTTAPSVYPLAPVCGDTTGSSVTLGCLVKGYFPEPVTLT WNSGSLSSGVHTFPAVLQSDLYTLSSSVTVTSSTWPSQSITCNVAHPASSTKVDKKI EPRGPTIKPCPPCKCPAPNAAGGPSVFIFPPKIKDVLMISLSPIVTCVVVDVSEDDPD VQISWFVNNVEVHTAQTQTHREDYNSTLRVVSALPIQHQDWMSGKEFKCKVNN KDLGAPIERTISKPKGSVRAPQVYVLPPPEEEMTKKQVTLTCMVTDFMPEDIYVEW TNNGKTELNYKNTEPVLDSDGSYFMYSKLRVEKKNWVERNSYSCSVVHEGLHNHH TTKSFSRTPGK |
| | SEQ ID NO: 277 | DIQMTQSPSSLSASVGDRVTITCRASQSISSYLNWYQQKPGKAPKLLIYAASSLQSG VPSRFSGSGSGTDFTLTISSLQPEDFATYYCQQSYSTPYTFGQGTKVEIKRADAAPTV SIFPPPSSEQLTSGGASVVCFLNNFYPKDINVKWKIDGSERQNGVLNSWTDQDSKDS TYSMSSTLTLTKDEYERHNSYTCEATHKTSTSPIVKSFNRNEC |
| AF2645 | SEQ ID NO: 95 | CDLPQTHSLGSRRTLMLLAQMRRISLFSCLKDRHDFGFPQEEFGNQFQKAETIPVL HEMIQQIFNLFSTKDSSAAWDETLLDKFYTELYQQLNDLEACVIQGVGVTETPLMK EDSILAVRKYFQRITLYLKEKKYSPCAWEVVRAEIMRSFSLSTNLQESLRSKEVPGVG VPGAGVPGVGVPGGGVPGVGVPGGGVPGAGVPGGGVPGVGVPGAGVPGVGV PGGGVQVLVQSGAEVKKPGASVKVSCKASGGTFSSYAISWVRQAPGQGLEWMG IIDPSVTYTRYAQKFQGRVTMTRDTSTSTVYMELSSLRSEDTAVYYCARSLFPTIFGV EVAFDIWGQGTLVTVSSAKTTAPSVYPLAPVCGDTTGSSVTLGCLVKGYFPEPVTLT WNSGSLSSGVHTFPAVLQSDLYTLSSSVTVTSSTWPSQSITCNVAHPASSTKVDKKI EPRGPTIKPCPPCKCPAPNAAGGPSVFIFPPKIKDVLMISLSPIVTCVVVDVSEDDPD VQISWFVNNVEVHTAQTQTHREDYNSTLRVVSALPIQHQDWMSGKEFKCKVNN KDLGAPIERTISKPKGSVRAPQVYVLPPPEEEMTKKQVTLTCMVTDFMPEDIYVEW TNNGKTELNYKNTEPVLDSDGSYFMYSKLRVEKKNWVERNSYSCSVVHEGLHNHH TTKSFSRTPGK |
| | SEQ ID NO: 112 | DIQMTQSPSSLSASVGDRVTITCRASQSISNRLAWYQQKPGKAPKLLIYKASSLESG VPSRFSGSGSGTDFTLTISSLQPEDFATYYCQQSNSTPFTFGQGTKVEIKRADAAPTV SIFPPPSSEQLTSGGASVVCFLNNFYPKDINVKWKIDGSERQNGVLNSWTDQDSKDS TYSMSSTLTLTKDEYERHNSYTCEATHKTSTSPIVKSFNRNEC |
| AF2615 | SEQ ID NO: 279 | QVQLVQSGAEVKKPGASVKVSCKASGNTFTDYYMHWVRQAPGQGLEWMGWM NPNSGNTGYAQKFQGRVTMTRDTSTSTVYMELSSLRSEDTAVYYCARSLFPTIFGV EVAFDIWGQGTLVTVSSAKTTAPSVYPLAPVCGDTTGSSVTLGCLVKGYFPEPVTLT WNSGSLSSGVHTFPAVLQSDLYTLSSSVTVTSSTWPSQSITCNVAHPASSTKVDKKI EPRGPTIKPCPPCKCPAPNAAGGPSVFIFPPKIKDVLMISLSPIVTCVVVDVSEDDPD VQISWFVNNVEVHTAQTQTHREDYNSTLRVVSALPIQHQDWMSGKEFKCKVNN KDLGAPIERTISKPKGSVRAPQVYVLPPPEEEMTKKQVTLTCMVTDFMPEDIYVEW TNNGKTELNYKNTEPVLDSDGSYFMYSKLRVEKKNWVERNSYSCSVVHEGLHNHH TTKSFSRTPGK |
| | SEQ ID NO: 280 | CDLPQTHSLGSRRTLMLLAQMRRISLFSCLKDRHDFGFPQEEFGNQFQKAETIPVL HEMIQQIFNLFSTKDSSAAWDETLLDKFYTELYQQLNDLEACVIQGVGVTETPLMK EDSILAVRKYFQRITLYLKEKKYSPCAWEVVRAEIMRSFSLSTNLQESLRSKEGGGGS GGGGSGGGGSGGGGSDIQMTQSPSSLSASVGDRVTITCQASQDISNYLNWYQQK PGKAPKLLIYAASSLQSGVPSRFSGSGSGTDFTLTISSLQPEDFATYYCQQSYSTPPTF GQGTRLEIKRADAAPTVSIFPPPSSEQLTSGGASVVCFLNNFYPKDINVKWKIDGSER QNGVLNSWTDQDSKDSTYSMSSTLTLTKDEYERHNSYTCEATHKTSTSPIVKSFNR NEC |
| AF2616 | SEQ ID NO: 281 | QVQLVQSGAEVKKPGASVKVSCKASGGTFSSYAISWVRQAPGQGLEWMGIIDPS VTYTRYAQKFQGRVTMTRDTSTSTVYMELSSLRSEDTAVYYCARSLFPTIFGVEVAF DIWGQGTLVTVSSAKTTAPSVYPLAPVCGDTTGSSVTLGCLVKGYFPEPVTLTWNS GSLSSGVHTFPAVLQSDLYTLSSSVTVTSSTWPSQSITCNVAHPASSTKVDKKIEPRG PTIKPCPPCKCPAPNAAGGPSVFIFPPKIKDVLMISLSPIVTCVVVDVSEDDPDVQIS WFVNNVEVHTAQTQTHREDYNSTLRVVSALPIQHQDWMSGKEFKCKVNNKDLG APIERTISKPKGSVRAPQVYVLPPPEEEMTKKQVTLTCMVTDFMPEDIYVEWTNN GKTELNYKNTEPVLDSDGSYFMYSKLRVEKKNWVERNSYSCSVVHEGLHNHHTTK SFSRTPGK |
| | SEQ ID NO: 282 | CDLPQTHSLGSRRTLMLLAQMRRISLFSCLKDRHDFGFPQEEFGNQFQKAETIPVL HEMIQQIFNLFSTKDSSAAWDETLLDKFYTELYQQLNDLEACVIQGVGVTETPLMK EDSILAVRKYFQRITLYLKEKKYSPCAWEVVRAEIMRSFSLSTNLQESLRSKEGGGGS GGGGSGGGGSGGGGSDIQMTQSPSSLSASVGDRVTITCQASQSISNRLAWYQQK PGKAPKLLIYKASSLESGVPSRFSGSGSGTDFTLTISSLQPEDFATYYCQQTYSTPITFG QGTKVEIKRADAAPTVSIFPPPSSEQLTSGGASVVCFLNNFYPKDINVKWKIDGSERQ NGVLNSWTDQDSKDSTYSMSSTLTLTKDEYERHNSYTCEATHKTSTSPIVKSFNRN EC |

TABLE 26-continued

DBA-cytokine protein complexes

| Protein Complex | SEQ ID NO: | Sequence |
|---|---|---|
| AF2696 | SEQ ID NO: 283 | QVQLVQSGAEVKKPGASVKVSCKASGYTFSGYYMHWVRQAPGQGLEWMGWM DPNSGYTGYAHQFQGRVTMTRDTSTSTVYMELSSLRSEDTAVYYCAKEVFSGWYD YWGQGTLVTVSSAKTTAPSVYPLAPVCGDTTGSSVTLGCLVKGYFPEPVTLTWNSG SLSSGVHTFPAVLQSDLYTLSSSVTVTSSTWPSQSITCNVAHPASSTKVDKKIEPRGP TIKPCPPCKCPAPNAAGGPSVFIFPPKIKDVLMISLSPIVTCVVVDVSEDDPDVQISW FVNNVEVHTAQTQTHREDYNSTLRVVSALPIQHQDWMSGKEFKCKVNNKDLGAP lERTISKPKGSVRAPQVYVLPPPEEEMTKKQVTLTCMVTDFMPEDlYVEWTNNGKT ELNYKNTEPVLDSDGSYFMYSKLRVEKKNWVERNSYSCSVVHEGLHNHHTTKSFSR TPGK |
| | SEQ ID NO: 284 | CDLPQTHSLGSRRTLMLLAQMRRISLFSCLKDRHDFGFPQEEFGNQFQKAETIPVL HEMIQQIFNLFSTKDSSAAWDETLLDKFYTELYQQLNDLEACVIQGVGVTETPLMK EDSILAVRKYFQRITLYLKEKKYSPCAWEVVRAEIMRSFSLSTNLQESLRSKEGGGGS GGGGSGGGGSGGGGSDIQMTQSPSSLSASVGDRVTITCRASQTISSYLNWYQQKP GKAPKLLIYAASTLESGVPSRFSGSGSGTDFTLTISSLQPEDFATYYCQQGYSTPITFG PGTKVDIKRADAAPTVSIFPPSSEQLTSGGASVVCFLNNFYPKDINVKWKIDGSERQ NGVLNSWTDQDSKDSTYSMSSTLTLTKDEYERHNSYTCEATHKTSTSPIVKSFNRN EC |
| AF2697 | SEQ ID NO: 214 | EVQLVESGGGLVQPGGSLRLSCAASGFNIKDTYIHWVRQAPGKGLEWVARIYPTN GYTRYADSVKGRFTISADTSKNTAYLQMNSLRAEDTAVYYCSRWGGDGFYAMDY WGQGTLVTVSSAKTTAPSVYPLAPVCGDTTGSSVTLGCLVKGYFPEPVTLTWNSGS LSSGVHTFPAVLQSDLYTLSSSVTVTSSTWPSQSITCNVAHPASSTKVDKKIEPRGPT IKPCPPCKCPAPNAAGGPSVFIFPPKIKDVLMISLSPIVTCVVVDVSEDDPDVQISWF VNNVEVHTAQTQTHREDYNSTLRVVSALPIQHQDWMSGKEFKCKVNNKDLGAPI ERTISKPKGSVRAPQVYVLPPPEEEMTKKQVTLTCMVTDFMPEDIYVEWTNNGKT ELNYKNTEPVLDSDGSYFMYSKLRVEKKNWVERNSYSCSVVHEGLHNHHTTKSFSR TPGK |
| | SEQ ID NO: 286 | CDLPQTHSLGSRRTLMLLAQMRRISLFSCLKDRHDFGFPQEEFGNQFQKAETIPVL HEMIQQIFNLFSTKDSSAAWDETLLDKFYTELYQQLNDLEACVIQGVGVTETPLMK EDSILAVRKYFQRITLYLKEKKYSPCAWEVVRAEIMRSFSLSTNLQESLRSKEGGGGS GGGGSGGGGSGGGGSDIQMTQSPSSLSASVGDRVTITCRASQDVNTAVAWYQQ KPGKAPKLLIYSASFLYSGVPSRFSGSRSGTDFTLTISSLQPEDFATYYCQQHYTTPPT FGQGTKVEIKRADAAPTVSIFPPSSEQLTSGGASVVCFLNNFYPKDINVKWKIDGSE RQNGVLNSWTDQDSKDSTYSMSSTLTLTKDEYERHNSYTCEATHKTSTSPIVKSFN RNEC |
| AF2698 | SEQ ID NO: 287 | EVQLVESGGGLVQPGGSLRLSCATSGYTFTEYIIHWVRQAPGKGLEWVASINPDYD ITNYNQRFKGRFTISLDKSKRTAYLQMNSLRAEDTAVYYCASWISDFFDYWGQGTL VTVSSAKTTAPSVYPLAPVCGDTTGSSVTLGCLVKGYFPEPVTLTWNSGSLSSGVHT FPAVLQSDLYTLSSSVTVTSSTWPSQSITCNVAHPASSTKVDKKIEPRGPTIKPCPPC KCPAPNAAGGPSVFIFPPKIKDVLMISLSPIVTCVVVDVSEDDPDVQISWFVNNVEV HTAQTQTHREDYNSTLRVVSALPIQHQDWMSGKEFKCKVNNKDLGAPIERTISKP KGSVRAPQVYVLPPPEEEMTKKQVTLTCMVTDFMPEDIYVEWTNNGKTELNYKN TEPVLDSDGSYFMYSKLRVEKKNWVERNSYSCSVVHEGLHNHHTTKSFSRTPGK |
| | SEQ ID NO: 288 | CDLPQTHSLGSRRTLMLLAQMRRISLFSCLKDRHDFGFPQEEFGNQFQKAETIPVL HEMIQQIFNLFSTKDSSAAWDETLLDKFYTELYQQLNDLEACVIQGVGVTETPLMK EDSILAVRKYFQRITLYLKEKKYSPCAWEVVRAEIMRSFSLSTNLQESLRSKEGGGGS GGGGSGGGGSGGGGSDIQMTQSPSSLSASVGDRVTITCRASQSVSTSSYSYMHW YQQKPGKAPKVLISYASNLESGVPSRFSGSGSGTDFTLTISSLQPEDFATYYCQHSW GIPRTFGQGTKVEIKRADAAPTVSIFPPSSEQLTSGGASVVCFLNNFYPKDINVKWKI DGSERQNGVLNSWTDQDSKDSTYSMSSTLTLTKDEYERHNSYTCEATHKTSTSPIV KSFNRNEC |

Example 29

Selection of IL-15 and PD-L1 Specific Dual Binding Antibodies

This example describes isolation of sensor domains of the present disclosure, specifically, selection of IL-15 and PD-L1 specific dual binding antibodies (DBAs). Anti-PD-L1 and anti-IL-15 DBAs were isolated from the IFNα Tumbler antibody phage display library described in EXAMPLE 1. The selection was similar to the protocol described in EXAMPLE 1, alternating between PD-L1 selection and IL-15 selection.

The final selection was plated as single colonies and 380 colonies were picked for Sanger sequencing. Thirty-eight unique clones were screened for PD-L1 and IL-15 binding. The scFv DNA sequence for each clone was synthesized as a gBlock (Integrated DNA Technologies, Inc.) with a T7 promoter, a translation initiation site, a Myc tag, the scFv sequence, a V5 tag and a T7 terminator. Proteins were expressed using the PUREfrex2.1 cell-free transcription/translation system as described in previous examples. The scFv samples were subjected to ELISA analysis to detect PDL1 and IL15 binding. In these experiments, wells of a 384-well plate were coated with an anti-V5 antibody (Sv5-Pk1, BioRad) at 1 ug/ml overnight at 4 degrees. After washing, wells were blocked with SuperBlock (ThermoFisher, 37515) followed by addition of saturating levels of scFvs in SuperBlock. After washing, antigens were added and plates incubated for one hour (PDL1-hFc-Avi, Acro Biosystems, PDL-H82F2); AF33 (SEQ ID NO: 298-299), biotinylated using standard methods; controls of PD1-hFc-Avi (Acro Biosystems, PD1-H82F1); AF35 (SEQ ID 63-64), biotinylated using standard methods). Biotinylated antigens were detected using streptavidin HRP using standard methods. Varying amounts of labeled test antigen were added to show binding and to estimate relative affinities of the different scFvs. FIGS. 23A-D show the ELISA binding data for four exemplary dual-binding scFvs AF635 (SEQ ID NO: 216), AF636 (SEQ ID NO: 217), AF666 (SEQ ID NO: 218) and AF614 (SEQ ID NO: 219). All four antibodies show binding to both PD-L1 and IL-15, with binding to PD-L1 detectable at a lower concentration of the antigen. Protein complex sequences are summarized in TABLE 27 below.

TABLE 27

| Protein Complex | SEQ ID NO: | Sequence |
|---|---|---|
| AF33 | SEQ ID NO: 298 | EVQLVESGGGLVQPGGSLRLSCAASGFNIKDTYIHWVRQAPGKGLEWVARIYPTN GYTRYADSVKGRFTISADTSKNTAYLQMNSLRAEDTAVYYCSRWGGDGFYAMDY WGQGTLVTVSSAKTTAPSVYPLAPVCGDTTGSSVTLGCLVKGYFPEPVTLTWNSGS LSSGVHTFPAVLQSDLYTLSSSVTVTSSTWPSQSITCNVAHPASSTKVDKKIEPRGPT IKPCPPCKCPAPNAAGGPSVFIFPPKIKDVLMISLSPIVTCVVVDVSEDDPDVQISWF VNNVEVHTAQTQTHREDYNSTLRVVSALPIQHQDWMSGKEFKCKVNNKDLGAPI ERTISKPKGSVRAPQVYVLPPPEEEMTKKQVTLTCMVTDFMPEDIYVEWTNNGKT ELNYKNTEPVLDSGSYFMYSKLRVEKKNWVERNSYSCSVVHEGLHNHHTTKSFSR TPGKGGGSGGGSHHHHHH |
| | SEQ ID NO: 299 | ITCPPPMSVEHADIWVKSYSLYSRERYICNSGFKRKAGTSSLTECVLNKATNVAHWT TPSLKCIRDPALVHQRPAPPSGGSGGGGSGGGSGGGGSLQNWVNVISDLKKIEDLI QSMHIDATLYTESDVHPSCKVTAMKCFLLELQVISLESGDASIHDTVENLIILANNSL SSNGNVTESGCKECEELEEKNIKEFLQSFVHIVQMFINTSGGGGSGGGGSGGGGSG GGGSDIQMTQSPSSLSASVGDRVTITCRASQDVNTAVAWYQQKPGKAPKLLIYSA SFLYSGVPSRFSGSRSGTDFTLTISSLQPEDFATYYCQQHYTTPPTFGQGTKVEIKRA DAAPTVSIFPPSSEQLTSGGASVVCFLNNFYPKDINVKWKIDGSERQNGVLNSWTD QDSKDSTYSMSSTLTLTKDEYERHNSYTCEATHKTSTSPIVKSFNRNEC |
| AF35 | SEQ ID NO: 63 | CDLPQTHSLGSRRTLMLLAQMRRISLFSCLKDRHDFGFPQEEFGNQFQKAETIPVL HEMIQQIFNLFSTKDSSAAWDETLLDKFYTELYQQLNDLEACVIQGVGVTETPLMK EDSILAVRKYFQRITLYLKEKKYSPCAWEVVRAEIMRSFSLSTNLQESLRSKEGGGGS GGGGSGGGGSGGGGSEVQLVESGGGLVQPGGSLRLSCAASGFNIKDTYIHWVRQ APGKGLEWVARIYPTNGYTRYADSVKGRFTISADTSKNTAYLQMNSLRAEDTAVYY CSRWGGDGFYAMDYWGQGTLVTVSSAKTTAPSVYPLAPVCGDTTGSSVTLGCLV KGYFPEPVTLTWNSGSLSSGVHTFPAVLQSDLYTLSSSVTVTSSTWPSQSITCNVAH PASSTKVDKKIEPRGPTIKPCPPCKCPAPNAAGGPSVFIFPPKIKDVLMISLSPIVTCV VVDVSEDDPDVQISWFVNNVEVHTAQTQTHREDYNSTLRVVSALPIQHQDWMS GKEFKCKVNNKDLGAPIERTISKPKGSVRAPQVYVLPPPEEEMTKKQVTLTCMVTD FMPEDIYVEWTNNGKTELNYKNTEPVLDSGSYFMYSKLRVEKKNWVERNSYSCS VVHEGLHNHHTTKSFSRTPGK |
| | SEQ ID NO: 64 | DIQMTQSPSSLSASVGDRVTITCRASQDVNTAVAWYQQKPGKAPKLLIYSASFLYS GVPSRFSGSRSGTDFTLTISSLQPEDFATYYCQQHYTTPPTFGQGTKVEIKRADAAP TVSIFPPSSEQLTSGGASVVCFLNNFYPKDINVKWKIDGSERQNGVLNSWTDQDSK DSTYSMSSTLTLTKDEYERHNSYTCEATHKTSTSPIVKSFNRNEC |
| AF635 | SEQ ID NO: 216 | MSTSTEQKLISEEDLQVQLVQSGAEVKKPGASVKVSCKASGYTFTGYYIHWVRQAP GQGLEWMGIINPSGGSTRYAOKFQGRVTMTRDTSTSTVYMELSSLRSEDTAVYYC ARSLFPTIFGVEVAFDIWGQGTLVTVSSASGGGGSGGGGSGGGGSHASDIQMTQ SPSSLSASVGDRVTITCRASQSIRTYLNWYQQKPGKAPKLLIYSASNLQSGVPSRFSG SGSGTDFTLTISSLQPEDFATYYCQQANSFPFTFGPGTKVDIKGKPIPNPLLGLDST |
| AF636 | SEQ ID NO: 217 | MSTSTEQKLISEEDLQVQLVQSGAEVKKPGASVKVSCKASGYSPTSYYLHWVRQAP GQGLEWMGRISPRSGGTKNAQNFQGRVTMTRDTSTSTVYMELSSLRSEDTAVYY CVRSLFPTIFGVEVAFDIWGQGTLVTVSSASGGGGSGGGGSGGGGSHASDIQMT QSPSSLSASVGDRVTITCRASQSISSWLAWYQQKPGKAPKLLIYYASSLQSGVPSRFS GSGSGTDFTLTISSLQPEDFATYYCQQGYQYPYTFGQGTKLEIKGKPIPNPLLGLDST |
| AF666 | SEQ ID NO: 218 | MSTSTEQKLISEEDLQVQLVQSGAEVKKPGASVKVSCKASGYTFSTYYIHWVRQAP GQGLEWMGWMNPNSGNTYAQTFQGRVTMTRDTSTSTVYMELSSLRSEDTAV YYCARSLFPTIFGVEVAFDIWGQGTLVTVSSASGGGGSGGGGSGGGGSHASDIQM TQSPSSLSASVGDRVTITCRASQSISSYLNWYQQKPGKAPKLLIYAASSLQSGVPSRF SGSGSGTDFTLTISSLQPEDFATYYCQQGYSTPRTFGQGTKVEIKGKPIPNPLLGLDS T |
| AF614 | SEQ ID NO: 219 | MSTSTEQKLISEEDLQVQLVQSGAEVKKPGASVKVSCKASGYTFTNYYMHWVRQA PGQGLEWMGWMNPNSGNTGYAQKFQGRVTMTRDTSTSTVYMELSSLRSEDTA VYYCARSLFPTIFGVEVAFDIWGQGTLVTVSSASGGGGSGGGGSGGGGSHASDIQ MTQSPSSLSASVGDRVTITCRASQSISSYLNWYQQKPGKAPKLLIYAASSLQSGVPS RFSGSGSGTDFTLTISSLQPEDFATYYCQQSYSTPRTFGQGTKLEIKGKPIPNPLLGLD ST |

Example 30

Regulated IL-2 Receptor Signaling by a PD-L1/IL-15 Dual Binding Antibody (DBA) Cytokine Complex This example describes regulated IL-15 activity in a reporter cell line by PD-L1/IL-15 DBA-cytokine complexes. HEK-Blue™ IL-2 reporter cells (Invivogen Catalog #hkb-il2) were grown according to the vendors instructions. The cells express IL-2 receptor and respond to IL-2 or IL-15 signaling by induction of an enzyme that can be read with a colorimetric assay. The exemplary dual-binding scFv sequences AF635 (SEQ ID NO: 216), AF636 (SEQ ID NO: 217), AF666 (SEQ ID NO: 218) and AF614 (SEQ ID NO: 219) described in EXAMPLE 29 and TABLE 28, were used to assemble scFv DBA-cytokine complexes AF4455 (SEQ ID NO: 220), AF4456 (SEQ ID NO: 221), AF4457 (SEQ ID NO: 222), and AF4440 (SEQ ID NO: 223) respectively. Two monospecific anti-IL-15 scFv sequences were assembled into cytokine-scFv complexes AF4478 (SEQ ID NO: 224) and AF4479 (SEQ ID NO: 225) to serve as negative controls. Protein complex sequences are provided in TABLE 28 below. The proteins were expressed using a PUREfrex2.1 cell-free transcription/translation system. 384-well ELISA plates (Corning 3700) were coated with 25 microliters per well of 1 microgram per ml anti-V5 antibody (SV5-pk1) in 100 mM bicarbonate solution pH 9.0 overnight at 4° C. The plates were washed three times with 100 microliters PBS+ Tween and once with 50 ul/well of SuperBlock. The PUREfrex reactions for each sample were diluted 1:2, 160 in Superblock, added to the anti-V5-coated plates at 20 µl/well and incubated for 1 hour at room temperature to capture a uniform quantity of the scFv protein on the plate. Each plate was then washed three times with PBS with 0.05% Tween 20 (PBST). PDL-1 protein (Acro Biosystems Product #PD1-H5358) or Fc protein (Acro Biosystems Product #FCC-H5214) was diluted in growth media (DMEM complete) to 2-fold higher than the final concentration and 12.5 microliters added per well. After a 15 minute incubation 12.5 microliters of HEK-Blue™ IL-2 reporter cells (12,500 cells) were added to each well and incubated overnight. Five microliters from each well was transferred to a new plate containing 45 microliters of QuantiBlue solution (Invivogen Product #rep-qbs). After 30 to 60 minutes the absorbance at 630 nm was determined using a Perkin-Elmer Envision.

TABLE 28

DBA-cytokine protein complexes, and control protein complexes

| Protein Complex | SEQ ID NO: | Sequence |
|---|---|---|
| AF4455 | SEQ ID NO: 220 | MSTSTITCPPPMSVEHADIWVKSYSLYSRERYICNSGFKRKAGTSSLTECVLNKATN VAHWTTPSLKCIRDPALVHQRPAPPSGGSGGGGSGGGSGGGGSLQNWVNVISDL KKIEDLIQSMHIDATLYTESDVHPSCKVTAMKCFLLELQVISLESGDASIHDTVENLIIL ANNSLSSNGNVTESGCKECEELEEKNIKEFLQSFVHIVQMFINTSGGSGSGSGGSG GSGSGGSGSQVQLVQSGAEVKKPGASVKVSCKASGYTFTGYYIHWVRQAPGQGL EWMGIINPSGGSTRYAQKFQGRVTMTRDTSTSTVYMELSSLRSEDTAVYYCARSLF PTIFGVEVAFDIWGQGTLVTVSSASGGGGSGGGGSGGGGSHASDIQMTQSPSSLS ASVGDRVTITCRASQSIRTYLNWYQQKPGKAPKLLIYSASNLQSGVPSRFSGSGSGT DFTLTISSLQPEDFATYYCQQANSFPFTFGPGTKVDIKAAAGSGSEQKLISEEDLGKPI PNPLLGLDSTNA |
| AF4456 | SEQ ID NO: 221 | MSTSTITCPPPMSVEHADIWVKSYSLYSRERYICNSGFKRKAGTSSLTECVLNKATN VAHWTTPSLKCIRDPALVHQRPAPPSGGSGGGGSGGGSGGGGSLQNWVNVISDL KKIEDLIQSMHIDATLYTESDVHPSCKVTAMKCFLLELQVISLESGDASIHDTVENLIIL ANNSLSSNGNVTESGCKECEELEEKNIKEFLQSFVHIVQMFINTSGGSGSGSGGSG GSGSGGSGSQVQLVQSGAEVKKPGASVKVSCKASGYSFTSYYLHWVRQAPGQGL EWMGRISPRSGGTKNAQNFQGRVTMTRDTSTSTVYMELSSLRSEDTAVYYCVRSL FPTIFGVEVAFDIWGQGTLVTVSSASGGGGSGGGGSGGGGSHASDIQMTQSPSSL SASVGDRVTITCRASQSISSWLAWYQQKPGKAPKLLIYYASSLQSGVPSRFSGSGSG TDFTLTISSLQPEDFATYYCQQGYQYPYTFGQGTKLEIKAAAGSGSEQKLISEEDLGK PIPNPLLGLDSTNA |
| AF4457 | SEQ ID NO: 222 | MSTSTITCPPPMSVEHADIWVKSYSLYSRERYICNSGFKRKAGTSSLTECVLNKATN VAHWTTPSLKCIRDPALVHQRPAPPSGGSGGGGSGGGSGGGGSLQNWVNVISDL KKIEDLIQSMHIDATLYTESDVHPSCKVTAMKCFLLELQVISLESGDASIHDTVENLIIL ANNSLSSNGNVTESGCKECEELEEKNIKEFLQSFVHIVQMFINTSGGSGSGSGGSG GSGSGGSGSQVQLVQSGAEVKKPGASVKVSCKASGYTFSTYYIHWVRQAPGQGLE WMGWMNPNSGNTGYAQTFQGRVTMTRDTSTSTVYMELSSLRSEDTAVYYCARS LFPTIFGVEVAFDIWGQGTLVTVSSASGGGGSGGGGSGGGGSHASDIQMTQSPSS LSASVGDRVTITCRASQSISSYLNWYQQKPGKAPKLLIYAASSLQSGVPSRFSGSGSG TDFTLTISSLQPEDFATYYCQQGYSTPRTFGQGTKVEIKAAAGSGSEQKLISEEDLGK PIPNPLLGLDSTNA |
| AF4440 | SEQ ID NO: 223 | MSTSTITCPPPMSVEHADIWVKSYSLYSRERYICNSGFKRKAGTSSLTECVLNKATN VAHWTTPSLKCIRDPALVHQRPAPPSGGSGGGGSGGGSGGGGSLQNWVNVISDL KKIEDLIQSMHIDATLYTESDVHPSCKVTAMKCFLLELQVISLESGDASIHDTVENLIIL ANNSLSSNGNVTESGCKECEELEEKNIKEFLQSFVHIVQMFINTSGGSGSGSGGSG GSGSGGSGSQVQLVQSGAEVKKPGASVKVSCKASGYTFTNYYMHWVRQAPGQG LEWMGWMNPNSGNTGYAQKFQGRVTMTRDTSTSTVYMELSSLRSEDTAVYYCA RSLFPTIFGVEVAFDIWGQGTLVTVSSASGGGGSGGGGSGGGGSHASDIQMTQSP SSLSASVGDRVTITCRASQSISSYLNWYQQKPGKAPKLLIYAASSLQSGVPSRFSGSG SGTDFTLTISSLQPEDFATYYCQQSYSTPRTFGQGTKLEIKAAAGSGSEQKLISEEDLG KPIPNPLLGLDSTNA |

TABLE 28-continued

DBA-cytokine protein complexes, and control protein complexes

| Protein Complex | SEQ ID NO: | Sequence |
|---|---|---|
| AF4478 | SEQ ID NO: 224 | MSTSTITCPPPMSVEHADIWVKSYSLYSRERYICNSGFKRKAGTSSLTECVLNKATN VAHWTTPSLKCIRDPALVHQRPAPPSGGSGGGGSGGGSGGGGSLQNWVNVISDL KKIEDLIQSMHIDATLYTESDVHPSCKVTAMKCFLLELQVISLESGDASIHDTVENLIIL ANNSLSSNGNVTESGCKECEELEEKNIKEFLQSFVHIVQMFINTSGGSGSGSGGSG GSGSGGSGSQVQLVQSGAEVKKPGASVKVSCKASGYTFTGYYIHWVRQAPGQGL EWMGWMNPNSGNTGYAQKFQGRVTMTRDTSTSTVYMELSSLRSEDTAVYYCA RSLFPTIFGVEVAFDIWGQGTLVTVSSASGGGGSGGGGSGGGGSHASDIQMTQSP SSLSASVGDRVTITCRASRSISSYLNWYQQKPGKAPKLLIYAASSLQSGVPSRFSGSG SGTDFTLTISSLQPEDFATYYCQQSYSTPRTFGQGTKVEIKAAAGSGSEQKLISEEDL GKPIPNPLLGLDSTNA |
| AF4479 | SEQ ID NO: 225 | MSTSTITCPPPMSVEHADIWVKSYSLYSRERYICNSGFKRKAGTSSLTECVLNKATN VAHWTTPSLKCIRDPALVHQRPAPPSGGSGGGGSGGGSGGGGSLQNWVNVISDL KKIEDLIQSMHIDATLYTESDVHPSCKVTAMKCFLLELQVISLESGDASIHDTVENLIIL ANNSLSSNGNVTESGCKECEELEEKNIKEFLQSFVHIVQMFINTSGGSGSGSGGSG GSGSGGSGSQVQLVQSGAEVKKPGSSVKVSCKASGYSFTDYYVHWVRQAPGQGL EWVGGINPKRGDTVFAQKFQGRVTITADESTSTAYMELSSLRSEDTAVYYCARGGL GVFGVVDVWGQGTTVTVSSASGGGGSGGGGSGGGGSHASDIVMTQSPLSLPVT PGEPASISCRSSQSLLHSNGYNYLDWYLQKPGQSPQLLIYAATTLQSGVPDRFSGSG SGTDFTLKISRVEAEDVGVYYCMQALQTPLTFGGGTKLEIKAAAGSGSEQKLISEEDL GKPIPNPLLGLDST |

The results are shown in FIGS. 24A-F. IL-15 activity increased in a dose dependent manner with the addition of PD-L1 (circles) but not with the addition of Fc protein (squares) for DBA-cytokine complexes AF4455 (SEQ ID NO: 220), AF4456 (SEQ TD NO: 221), AF4457 (SEQ TD NO: 222) and AF4440 (SEQ IDF: 223). IL-15 activity from the monospecific IL-15 scFv cytokine complexes AF4478 (SEQ TD NO: 224) and AF4479 (SEQ TD NO: 225) did not change with the addition of PD-L1 or Fc protein.

The exemplary dual-binding antibody sequences from AF614 (SEQ TD NO: 219) and AF666 (SEQ TD NO: 218) were assembled into asymmetric IgG molecules with IL-15 appended to the N-terminus of one heavy chain through a flexible linker (as shown schematically in FIG. 9b) to create AF4591 (SEQ TD NO: 226-228) and AF4592 (SEQ TD NO: 229-231) respectively. Two controls were assembled in the same format from an anti-G-15 antibody (AF4659, SEQ ID NO: 232-234) and a PDL1-IFN dual-binding antibody (AF4660, SEQ TD NO: 235-237). Protein complex sequences are summarized in TABLE 29. The proteins were expressed in mammalian cells and purified using standard protocols. The four antibody-cytokine complexes were assayed for IL-15 activity using HEK-Blue™ IL-2 reporter cells in an assay similar to that described above, with the exception that all of the proteins were in solution in the growth media. The purified antibody-cytokine complexes were diluted to a final concentration of 100 pM and assayed in varying concentrations of PD-L1 or a control IgG1 antibody.

TABLE 29

DBA-cytokine protein complexes, and control protein complexes

| Protein Complex | SEQ ID NO: | Sequence |
|---|---|---|
| AF4591 | SEQ ID NO: 226 | ITCPPPMSVEHADIWVKSYSLYSRERYICNSGFKRKAGTSSLTECVLNKATN VAHWTTPSLKCIRDPALVHQRPAPPSGGSGGGGSGGGSGGGGSLQNW VNVISDLKKIEDLIQSMHIDATLYTESDVHPSCKVTAMKCFLLELQVISLESG DASIHDTVENLIILANNSLSSNGNVTESGCKECEELEEKNIKEFLQSFVHIVQ MFINTSGGGGSGGGGSGGGGSGGGGSQVQLVQSGAEVKKPGASVKVS CKASGYTFTNYYMHWVRQAPGQGLEWMGWMNPNSGNTGYAQKFQ GRVTMTRDTSTSTVYMELSSLRSEDTAVYYCARSLFPTIFGVEVAFDIWGQ GTLVTVSSAKTTAPSVYPLAPVCGDTTGSSVTLGCLVKGYFPEPVTLTWNS GSLSSGVHTFPAVLQSDLYTLSSSVTVTSSTWPSQSITCNVAHPASSTKVD KKIEPRGPTIKPCPPCKCPAPNAAGGPSVFIFPPKIKDVLMISLSPIVTCVVV DVSEDDPDVQISWFVNNVEVHTAQTQTHREDYNSTLRVVSALPIQHQD WMSGKEFKCKVNNKDLGAPIERTISKPKGSVRAPQVYVLPPPEEEMTKK QVTLTCMVTDFMPEDIYVEWTNNGKTELNYKNTEPVLDSDGSYFMYSDL RVEKKNWVERNSYSCSVVHEGLHNHHTTESFSRTPGK |
| | SEQ ID NO: 227 | QVQLVQSGAEVKKPGASVKVSCKASGYTFTNYYMHWVRQAPGQGLEW MGWMNPNSGNTGYAQKFQGRVTMTRDTSTSTVYMELSSLRSEDTAVY YCARSLFPTIFGVEVAFDIWGQGTLVTVSSAKTTAPSVYPLAPVCGDTTGS SVTLGCLVKGYFPEPVTLTWNSGSLSSGVHTFPAVLQSDLYTLSSSVTVTSS TWPSQSITCNVAHPASSTKVDKKIEPRGPTIKPCPPCKCPAPNAAGGPSVF IFPPKIKDVLMISLSPIVTCVVVDVSEDDPDVQISWFVNNVEVHTAQTQTH REDYNSTLRVVSALPIQHQDWMSGKEFKCKVNNKDLGAPIERTISKPKGS VRAPQVYVLPPPEKEMTKKQVSLTCLVKDFMPEDIYVEWTNNGKTELNY KNTEPVLKSDGSYFMYSKLTVEKKNWVERNSYSCSVVHEGLHNHHTTKSF SRTPGK |

TABLE 29-continued

DBA-cytokine protein complexes, and control protein complexes

| Protein Complex | SEQ ID NO: | Sequence |
|---|---|---|
| | SEQ ID NO: 228 | DIQMTQSPSSLSASVGDRVTITCRASQSISSYLNWYQQKPGKAPKLLIYAA SSLQSGVPSRFSGSGSGTDFTLTISSLQPEDFATYYCQQSYSTPRTFGQGTK LEIKRADAAPTVSIFPPSSEQLTSGGASVVCFLNNFYPKDINVKWKIDGSER QNGVLNSWTDQDSKDSTYSMSSTLTLTKDEYERHNSYTCEATHKTSTSPI VKSFNRNEC |
| AF4592 | SEQ ID NO: 229 | ITCPPPMSVEHADIWVKSYSLYSRERYICNSGFKRKAGTSSLTECVLNKATN VAHWTTPSLKCIRDPALVHQRPAPPSGGSGGGGSGGGGSGGGGSLQNW VNVISDLKKIEDLIQSMHIDATLYTESDVHPSCKVTAMKCFLLELQVISLESG DASIHDTVENLIILANNSLSSNGNVTESGCKECEELEEKNIKEFLQSFVHIVQ MFINTSGGGGSGGGGSGGGGSGGGGSQVQLVQSGAEVKKPGASVKVS CKASGYTFSTYYIHWVRQAPGQGLEWMGWMNPNSGNTGYAQTFQGR VTMTRDTSTSTVYMELSSLRSEDTAVYYCARSLFPTIFGVEVAFDIWGQGT LVTVSSAKTTAPSVYPLAPVCGDTTGSSVTLGCLVKGYFPEPVTLTWNSGS LSSGVHTFPAVLQSDLYTLSSSVTVTSSTWPSQSITCNVAHPASSTKVDKKI EPRGPTIKPCPPCKCPAPNAAGGPSVFIFPPKIKDVLMISLSPIVTCVVVDV SEDDPDVQISWFVNNVEVHTAQTQTHREDYNSTLRVVSALPIQHQDW MSGKEFKCKVNNKDLGAPIERTISKPKGSVRAPQVYVLPPPEEEMTKKQV TLTCMVTDFMPEDIYVEWTNNGKTELNYKNTEPVLDSDGSYFMYSDLRV EKKNWVERNSYSCSVVHEGLHNHHTTESFSRTPGK |
| | SEQ ID NO: 230 | QVQLVQSGAEVKKPGASVKVSCKASGYTFSTYYIHWVRQAPGQGLEWM GWMNPNSGNTGYAQTFQGRVTMTRDTSTSTVYMELSSLRSEDTAVYYC ARSLFPTIFGVEVAFDIWGQGTLVTVSSAKTTAPSVYPLAPVCGDTTGSSV TLGCLVKGYFPEPVTLTWNSGSLSSGVHTFPAVLQSDLYTLSSSVTVTSST WPSQSITCNVAHPASSTKVDKKIEPRGPTIKPCPPCKCPAPNAAGGPSVFI FPPKIKDVLMISLSPIVTCVVVDVSEDDPDVQISWFVNNVEVHTAQTQTH REDYNSTLRVVSALPIQHQDWMSGKEFKCKVNNKDLGAPIERTISKPKGS VRAPQVYVLPPPEKEMTKKQVSLTCLVKDFMPEDIYVEWTNNGKTELNY KNTEPVLKSDGSYFMYSKLTVEKKNWVERNSYSCSVVHEGLHNHHTTKSF SRTPGK |
| | SEQ ID NO: 231 | DIQMTQSPSSLSASVGDRVTITCRASQSISSYLNWYQQKPGKAPKLLIYAA SSLQSGVPSRFSGSGSGTDFTLTISSLQPEDFATYYCQQGYSTPRTFGQGT KVEIKRADAAPTVSIFPPSSEQLTSGGASVVCFLNNFYPKDINVKWKIDGSE RQNGVLNSWTDQDSKDSTYSMSSTLTLTKDEYERHNSYTCEATHKTSTSP IVKSFNRNEC |
| AF4659 | SEQ ID NO: 232 | ITCPPPMSVEHADIWVKSYSLYSRERYICNSGFKRKAGTSSLTECVLNKATN VAHWTTPSLKCIRDPALVHQRPAPPSGGSGGGGSGGGGSGGGGSLQNW VNVISDLKKIEDLIQSMHIDATLYTESDVHPSCKVTAMKCFLLELQVISLESG DASIHDTVENLIILANNSLSSNGNVTESGCKECEELEEKNIKEFLQSFVHIVQ MFINTSGGGGSGGGGSGGGGSGGGGSQVQLVQSGAEVKKPGASVKVS CKASGDTFSSYAISWVRQAPGQGLEWMGWMNPNSGNTGYAQKFQGR VTMTRDTSTSTVYMELSSLRSEDTAVYYCATGITMIGYWGQGTLVTVSSA KTTAPSVYPLAPVCGDTTGSSVTLGCLVKGYFPEPVTLTWNSGSLSSGVHT FPAVLQSDLYTLSSSVTVTSSTWPSQSITCNVAHPASSTKVDKKIEPRGPTI KPCPPCKCPAPNAAGGPSVFIFPPKIKDVLMISLSPIVTCVVVDVSEDDPD VQISWFVNNVEVHTAQTQTHREDYNSTLRVVSALPIQHQDWMSGKEFK CKVNNKDLGAPIERTISKPKGSVRAPQVYVLPPPEEEMTKKQVTLTCMVT DFMPEDIYVEWTNNGKTELNYKNTEPVLDSDGSYFMYSDLRVEKKNWV ERNSYSCSVVHEGLHNHHTTESFSRTPGK |
| | SEQ ID NO: 233 | QVQLVQSGAEVKKPGASVKVSCKASGDTFSSYAISWVRQAPGQGLEWM GWMNPNSGNTGYAQKFQGRVTMTRDTSTSTVYMELSSLRSEDTAVYYC ATGITMIGYWGQGTLVTVSSAKTTAPSVYPLAPVCGDTTGSSVTLGCLVK GYFPEPVTLTWNSGSLSSGVHTFPAVLQSDLYTLSSSVTVTSSTWPSQSITC NVAHPASSTKVDKKIEPRGPTIKPCPPCKCPAPNAAGGPSVFIFPPKIKDVL MISLSPIVTCVVVDVSEDDPDVQISWFVNNVEVHTAQTQTHREDYNSTL RVVSALPIQHQDWMSGKEFKCKVNNKDLGAPIERTISKPKGSVRAPQVY VLPPPEKEMTKKQVSLTCLVKDFMPEDIYVEWTNNGKTELNYKNTEPVLK SDGSYFMYSKLTVEKKNWVERNSYSCSVVHEGLHNHHTTKSFSRTPGK |
| | SEQ ID NO: 234 | DIQMTQSPSSLSASVGDRVTITCQASQDISSYLNWYQQKPGKAPKLLIYAA STLQSGVPSRFSGSGSGTDFTLTISSLQPEDFATYYCQQSYSTPYTFGQGTK VEIKRADAAPTVSIFPPSSEQLTSGGASVVCFLNNFYPKDINVKWKIDGSER QNGVLNSWTDQDSKDSTYSMSSTLTLTKDEYERHNSYTCEATHKTSTSPI VKSFNRNEC |
| AF4660 | SEQ ID NO: 235 | ITCPPPMSVEHADIWVKSYSLYSRERYICNSGFKRKAGTSSLTECVLNKATN VAHWTTPSLKCIRDPALVHQRPAPPSGGSGGGGSGGGGSGGGGSLQNW VNVISDLKKIEDLIQSMHIDATLYTESDVHPSCKVTAMKCFLLELQVISLESG DASIHDTVENLIILANNSLSSNGNVTESGCKECEELEEKNIKEFLQSFVHIVQ MFINTSGGGGSGGGGSGGGGSGGGGSQVQLVQSGAEVKKPGASVKVS CKASGGTFSSYAISWVRQAPGQGLEWMGIIDPSMTYTRYAQKFQGRVT MTRDTSTSTVYMELSSLRSEDTAVYYCARSLFPTIFGLEVAFDIWGQGTLV TVSSAKTTAPSVYPLAPVCGDTTGSSVTLGCLVKGYFPEPVTLTWNSGSLS SGVHTFPAVLQSDLYTLSSSVTVTSSTWPSQSITCNVAHPASSTKVDKKIEP RGPTIKPCPPCKCPAPNAAGGPSVFIFPPKIKDVLMISLSPIVTCVVVDVSE |

TABLE 29-continued

DBA-cytokine protein complexes, and control protein complexes

| Protein Complex | SEQ ID NO: | Sequence |
|---|---|---|
| | | DDPDVQISWFVNNVEVHTAQTQTHREDYNSTLRVVSALPIQHQDWMS GKEFKCKVNNKDLGAPIERTISKPKGSVRAPQVYVLPPPEEEMTKKQVTLT CMVTDFMPEDIYVEWTNNGKTELNYKNTEPVLDSDGSYFMYSDLRVEKK NWVERNSYSCSVVHEGLHNHHTTESFSRTPGK |
| | SEQ ID NO: 236 | QVQLVQSGAEVKKPGASVKVSCKASGGTFSSYAISWVRQAPGQGLEWM GIIDPSMTYTRYAQKFQGRVTMTRDTSTSTVYMELSSLRSEDTAVYYCAR SLFPTIFGLEVAFDIWGQGTLVTVSSAKTTAPSVYPLAPVCGDTTGSSVTLG CLVKGYFPEPVTLTWNSGSLSSGVHTFPAVLQSDLYTLSSSVTVTSSTWPS QSITCNVAHPASSTKVDKKIEPRGPTIKPCPPCKCPAPNAAGGPSVFIFPPK IKDVLMISLSPIVTCVVVDVSEDDPDVQISWFVNNVEVHTAQTQTHREDY NSTLRVVSALPIQHQDWMSGKEFKCKVNNKDLGAPIERTISKPKGSVRAP QVYVLPPPEKEMTKKQVSLTCLVKDFMPEDIYVEWTNNGKTELNYKNTE PVLKSDGSYFMYSKLTVEKKNWVERNSYSCSVVHEGLHNHHTTKSFSRTP GK |
| | SEQ ID NO: 237 | DIQMTQSPSSLSASVGDRVTITCQASQSISNRLAWYQQKPGKAPKLLIYKA SSLESGVPSRFSGSGSGTDFTLTISSLQPEDFATYYCQQTYSTPITFGQGTK VEIKRADAAPTVSIFPPSSEQLTSGGASVVCFLNNFYPKDINVKWKIDGSER QNGVLNSWTDQDSKDSTYSMSSTLTLTKDEYERHNSYTCEATHKTSTSPI VKSFNRNEC |

The results are shown in FIGS. 25A-D. IL-15 activity increased in a dose dependent manner with the addition of PD-L1 but not with the addition of Fc protein for DBA-cytokine complexes AF4591 (SEQ ID NO: 226-228) and AF4592 (SEQ ID NO: 229-231). IL-15 activity from the monospecific IL-15 scFv cytokine complexes AF4659 (SEQ ID NO: 232-234) and AF4660 (SEQ ID NO: 235-237) did not change with the addition of PD-L1 or Fc protein.

Protein complexes of the present invention based on four different PD-L1/IL-15 dual-binding antibodies produced in two different formats showed PD-L1-dependent IL-15 activity.

Example 31

Selection and Binding of IFN and CEA Specific Dual Binding Antibodies

This example describes isolation of sensor domains of the present disclosure, specifically, selection of IFNα and CEA specific dual binding antibodies (DBAs). Anti-CEA and anti-IFNα DBAs were isolated from a Tumbler antibody phage display library similar to the library described in EXAMPLE 1. The antibody phage display library was constructed to incorporate the heavy chain CDR1, heavy chain CDR2, and light chain diversity of the Superhuman 2.0 antibody library combined with various heavy chain ("HC") CDR3 sequences from anti-IFNα antibodies (TABLE 18). The selection was similar to the protocol described in EXAMPLE 1, using one round of IFNα selection (IFNα2b, GenScript, Z03002, biotinylated using standard protocols) and one round of CEA selection (CEA-hFc, Sino Biologicals, 11077-H02H).

TABLE 18

HC-CDR3 of IFNα binders

| SEQ ID NO | Sequence | Description |
|---|---|---|
| SEQ ID NO: 238 | CASGGSYSPWYFDLW | HC-CDR3 of IFNα binder |
| SEQ ID NO: 239 | CASLAAAGPYYYYGMDVW | HC-CDR3 of IFNα binder |
| SEQ ID NO: 240 | CVSSVGAGAYYYQGLDVW | HC-CDR3 of IFNα binder |
| SEQ ID NO: 241 | CARDHDYLTSFGYW | HC-CDR3 of IFNα binder |
| SEQ ID NO: 242 | CAFSSPTYYYYYGMDVW | HC-CDR3 of IFNα binder |
| SEQ ID NO: 243 | CARVNYDFWSGQSLRFDPW | HC-CDR3 of IFNα binder |
| SEQ ID NO: 244 | CATIKGLGAYYYYGMDVW | HC-CDR3 of IFNα binder |
| SEQ ID NO: 245 | CASDHGWLDAFDIW | HC-CDR3 of IFNα binder |
| SEQ ID NO: 246 | CARDWYGDYFDYW | HC-CDR3 of IFNα binder |
| SEQ ID NO: 247 | CARGILSDYGDHAFDYW | HC-CDR3 of IFNα binder |
| SEQ ID NO: 248 | CARVDSSSSLHFDYW | HC-CDR3 of IFNα binder |

TABLE 18-continued

HC-CDR3 of IFNα binders

| SEQ ID NO | Sequence | Description |
|---|---|---|
| SEQ ID NO: 249 | CARTSGYDLLFDYW | HC-CDR3 of IFNα binder |
| SEQ ID NO: 250 | CARVGGWGIYYYYGMDVW | HC-CDR3 of IFNα binder |
| SEQ ID NO: 251 | CARDPSYSTGYYDYW | HC-CDR3 of IFNα binder |
| SEQ ID NO: 252 | CARGSRADYW | HC-CDR3 of IFNα binder |

Figure 26:
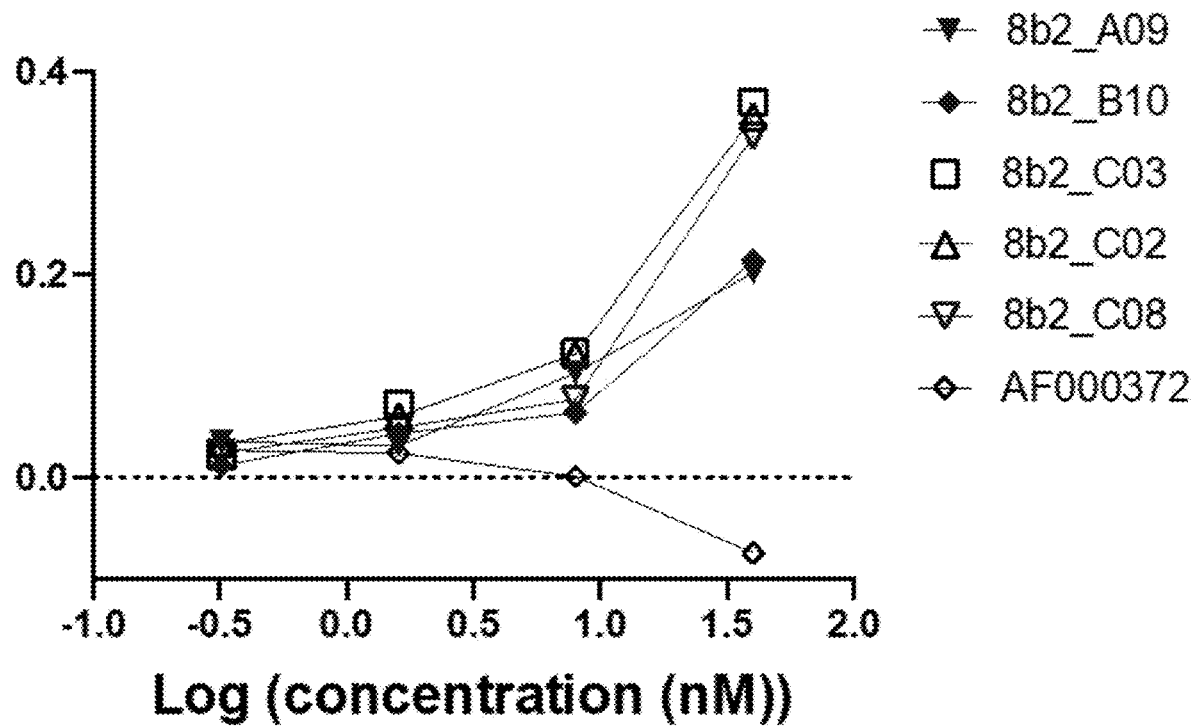
FIG. 26 shows ELISA binding data for five dual-binding scFvs binding to CEA.
Figure 27A:
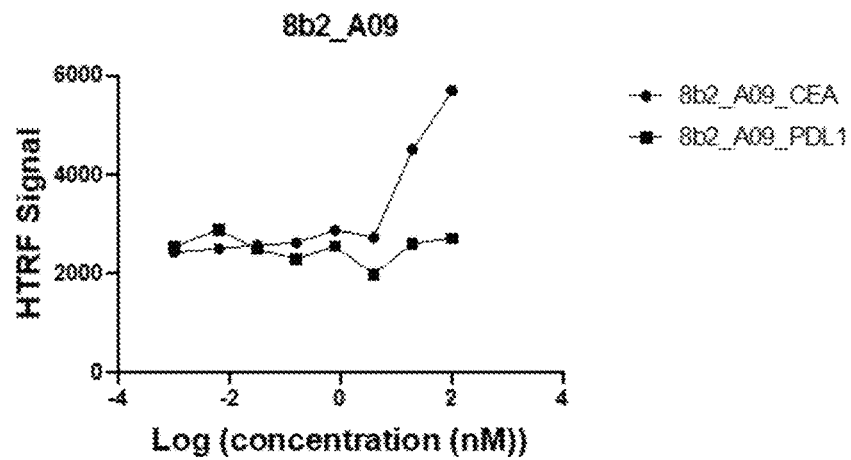
FIG. 27A-F demonstrate IFNAR2 binding by three DBA-cytokine protein complexes, an IFNα monospecific binding scFv, and two non-IFNα binding scFvs.
Figure 27B:
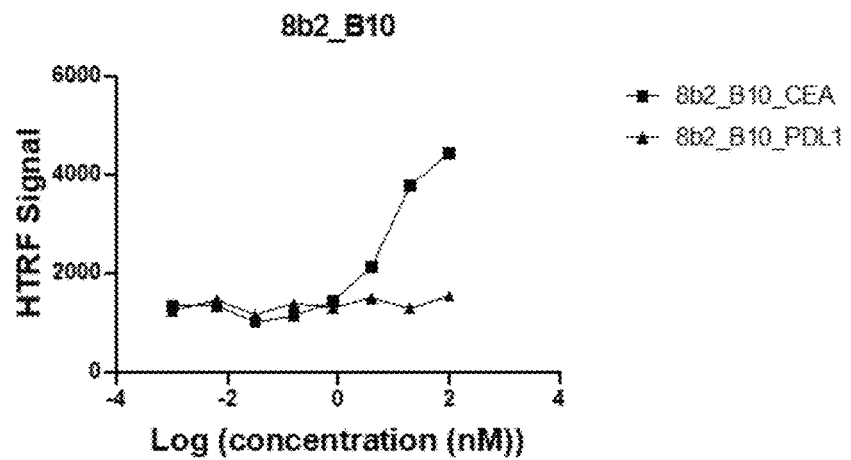
Figure 27C:
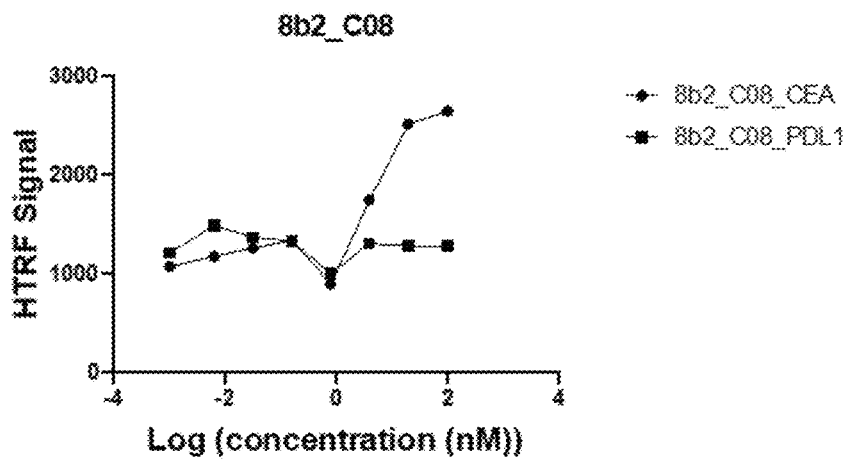
Figure 27D:
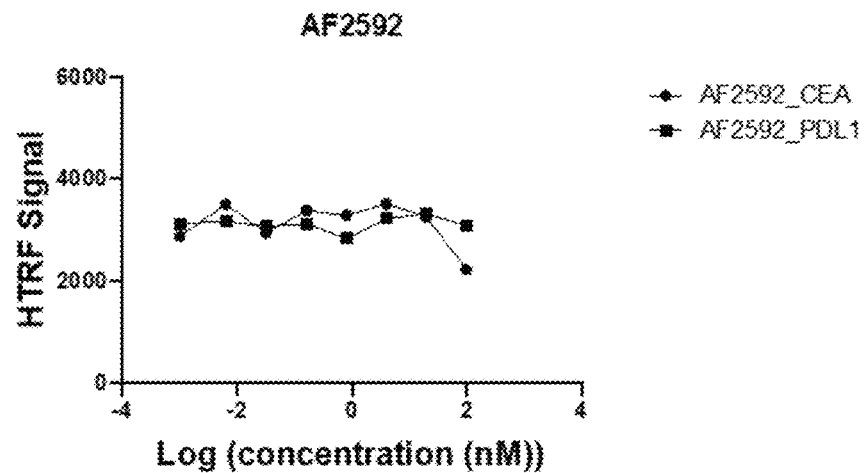
Figure 27E:
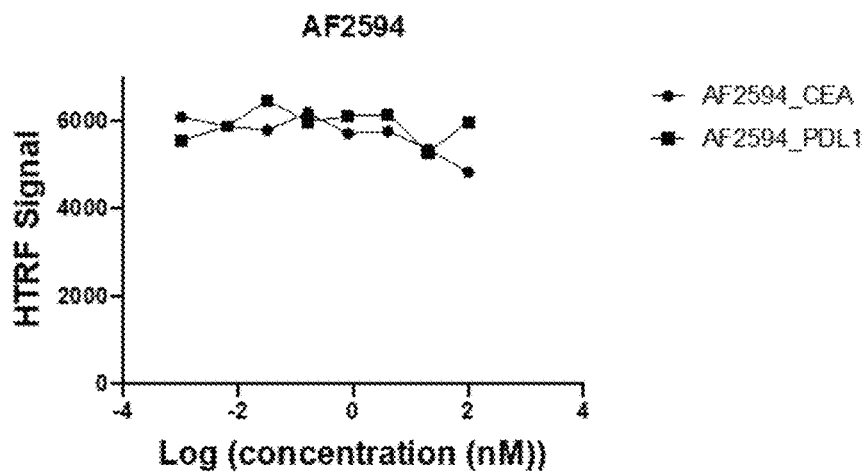
Figure 27F:
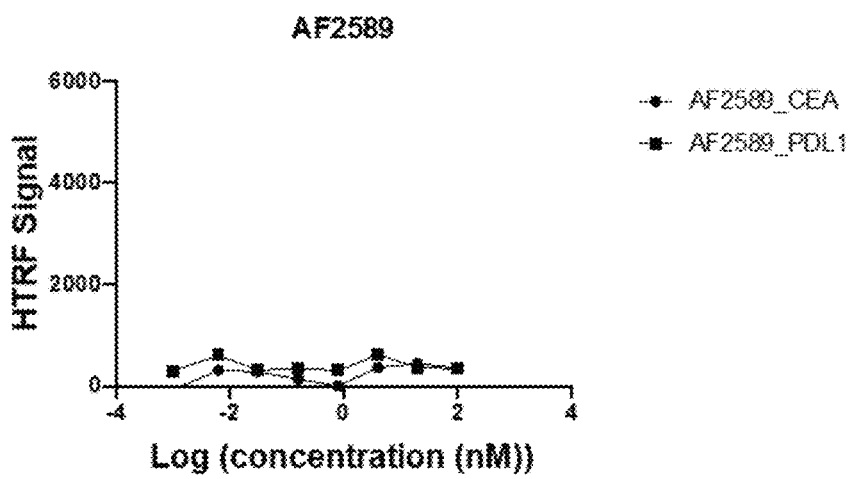

Following two rounds of selection in phage, the resulting library of DBAs was subcloned into a yeast surface display vector and transformed into yeast for further screening using standard protocols. The yeast library was sorted four times for binding to CEA and IFNα. In each round of sorting, the library was labeled with either CEA-Fc-biotin or IFNα-biotin, then with Streptavidin-PE (Abcam #ab239759), and sorted based on PE fluorescence on a Sony MA900 cell sorter. The four sorts were carried out with labelling at 100 nM CEA-Fc-biotin, 1000 nM IFNα-biotin, 10 nM CEA-Fc-biotin, and 20 nM CEA-Fc-biotin. Plasmids were rescued from the yeast after the final sort using a Zymoprep Yeast Plasmid Miniprep II kit (Zymo research D2004) and transformed into DH5a *E. coli* for cloning. Ninety-six colonies were picked for Sanger sequencing, from which thirty-four unique clones were identified and screened for IFNα and CEA binding. The scFv DNA sequence for each clone, including c-myc and V5 tags, was amplified by PCR using a forward primer containing a T7 promoter and a translation initiation site, and a reverse primer containing a T7 terminator. Proteins were expressed using the PUREfrex2.1 cell-free transcription/translation system as described in previous examples. The scFv samples were subjected to ELISA analysis to detect CEA and IFNα binding. In these experiments, wells of a 384-well plate are coated with an anti-V5 antibody (Sv5-Pk1, BioRad) at 1 ug/ml overnight at 4 degrees. After washing, wells are blocked with SuperBlock (ThermoFisher, 37515) followed by addition of saturating levels of scFvs in SuperBlock. After washing, antigens are added and plates incubated for one hour. Biotinylated IFNα is detected using streptavidin HRP and CEA-Fc is detected using anti-hFc-HRP, and developed using standard methods. Varying amounts of labelled test antigen were added to show binding and to estimate relative affinities of the different scFvs. FIG. 26 shows the ELISA binding data for five exemplary dual-binding scFvs binding to CEA. Because the binding affinity for IFNα was too low to detect by ELISA, the binding to IFNα was measured by Biolayer Interferometry (OctetRED96e) as described in Example 5. Results are tabulated in TABLE 19. All five show binding to both CEA and IFN, with binding to CEA detectable at a lower concentration of the antigen.

TABLE 19

Anti-IFNα Binding Results

| CloneID | IFNα binding (@5 uM) | ELISA | SEQUENCES | HC-CDR3 |
|---|---|---|---|---|
| 8b2_A09 | + | − | (SEQ ID NO: 253) MSTSTEVQLLESGGGLVQPGGSLRLSCAAS GFTFSSYAMHWVRQAPGKGLEWVSAIGA GGGTYYADSVKGRFTISRDDSKNTLYLQM NSLKTEDTAVYYCVSSVGAGAYYYQGLDV WGQGTLVTVSSASGGGGSGGGGSGGGG SHASDIQMTQSPSSLSASVGDRVTITCRAS QDIFTYLNWYQQRPGKAPKLLIYDASRLQT GVPSRFSGSGSGTDFTLTISSLQPEDFATYY CQQSYSIPYTFGQGTKLEIKRAAAGSGSEQ KLISEEDLGKPIPNPLLGLDST | SEQ ID NO: 240 |
| 8b2_B10 | + | − | (SEQ ID NO: 254) MSTSTEVQLLESGAEVKKPGGSLR LSCAASGFTVSSNYMSWVRQAPG KGLEWVSAISGSGGSTYYADFVKG RFTISRDNSKNTLYLQMNSLRAED TAVYYCVSSVGAGAYYYQGLDV WGQGTLVTVSSASGGGGSGGGS GGGGSHASDIQMTQSPSSLSASVG DRVTITCRASQGVGNFLAWYQQKP GKAPKLLIYGASTLQSGVPSRFSGS GSGTDFTLTISSLQPEDFATYYCQQ SYSTPFTFGGGTKLEIKRAAAGSGS EQKLISEEDLGKPIPNPLLGLDST | SEQ ID NO: 240 |

TABLE 19-continued

Anti-IFNα Binding Results

| CloneID | IFNα binding (@5 uM) | ELISA | SEQUENCES | HC-CDR3 |
|---|---|---|---|---|
| 862_C02 | + | − | — | |
| 8b2_C03 | + | − | — | |
| 8b2_C08 | + | − | (SEQ ID NO: 256) MSTSTEVQLLESGAEVKKPGGSLR LSCAASGFTFSSYAMSWVRQAPGK GLEWVSAISGSGGSTYYADSVKGR FTISRDNSKNTLYLQMNSLRAEDT AVYYCARVDSSSLHFDYWGQGT LVTVSSASGGGSGGGGSGGGGSH ASDIQMTQSPSSLSASVGDRVTITC RASQRIGTYLNWYQQKPGKAPKLL IYAASNLQSGVPSRFSGSGSGTDFT LTISSLQPEDFATYYCLQTFNTPFTF GPGTKVDIKRAAAGSGSEQKLISEE DLGKPIPNPLLGLDST | SEQ ID NO: 248 |
| AF317 | (KD < 10nM) | +++ | (SEQ ID NO: 257) MSTSTEQKLISEEDLQVQLVQSGAE VKKPGASVKVSCKASGYSFTSYDI NWVRQAPGQGLEWIGMINPSSGFT SAAQTFQGRVTMTRDTSTSTVYME LSSLRSEDTAVYYCATIKGLGAYY YYGMDVWGQGTTVTVSSASGGGG SGGGGSGGGGSHASDIQMTQSPSS LSASVGDRVTITCRASQSIDRYLNW YQQKPGKAPKLLIYAASSLQSGVPS RFSGSGSGTDFTLTISSLQPEDFATY YCQQSYSPPLTFGGGTKVEIKGSGL NDIFEAQKIEWHEGKPIPNPLLGLD ST | SEQ ID NO: 244 |
| AF372 | − | − | (SEQ ID NO: 258) MSTSTEQKLISEEDLEVQLVESGGG LVQPGGSLRLSCAASGFNIKDTYIH WVRQAPGKGLEWVARIYPTNGYT RYADSVKGRFTISADTSKNTAYLQ MNSLRAEDTAVYYCSRWGGDGFY AMDYWGQGTLVTVSSASGGGSG GGGSGGGGSHASDIQMTQSPSSLS ASVGDRVTITCRASQDVNTAVAW YQQKPGKAPKLLIYSASFLYSGVPS RFSGSRSGTDFTLTISSLQPEDFATY YCQQHYTTPPTFGQGTKVEIKGSG LNDIFEAQKIEWHEGKPIPNPLLGL DST | — |

Example 32

Regulated IFNAR2 (IFNα Receptor 2) Binding by a CEA-IFNα Dual Binding Antibody (DBA) C

TABLE 30

DBA-cytokine protein complexes, and control protein complexes

| Protein Complex | SEQ ID NO: | Sequence |
|---|---|---|
| DBA-cytokine complex | SEQ ID NO: 259 | MSTSTCDLPQTHSLGSRRTLMLLAQMRRISLFSCLKDRHDFGFPQE EFGNQFQKAETIPVLHEMIQQIFNLFSTKDSSAAWDETLLDKFYTEL YQQLNDLEACVIQGVGVTETPLMKEDSILAVRKYFQRITLYLKEKK YSPCAWEVVRAEIMRSFSLSTNLQESLRSKEGGSGSGSGGSGGSGS GGSGSEVQLLESGGGLVQPGGSLRLSCAASGFTFSSYAMHWVRQA PGKGLEWVSAIGAGGGTYYADSVKGRFTISRDDSKNTLYLQMNSL KTEDTAVYYCVSSVGAGAYYYQGLDVWGQGTLVTVSSASGGGGS GGGGSGGGGSHASDIQMTQSPSSLSASVGDRVTITCRASQDIFTYL NWYQQRPGKAPKLLIYDASRLQTGVPSRFSGSGSGTDFTLTISSLQP EDFATYYCQQSYSIPYTFGQGTKLEIKRAAAGSGSEQKLISEEDLGK PIPNPLLGLDST |
| DBA-cytokine complex | SEQ ID NO: 260 | MSTSTCDLPQTHSLGSRRTLMLLAQMRRISLFSCLKDRHDFGFPQE EFGNQFQKAETIPVLHEMIQQIFNLFSTKDSSAAWDETLLDKFYTEL YQQLNDLEACVIQGVGVTETPLMKEDSILAVRKYFQRITLYLKEKK YSPCAWEVVRAEIMRSFSLSTNLQESLRSKEGGSGSGSGGSGGSGS GGSGSEVQLLESGAEVKKPGGSLRLSCAASGFTVSSNYMSWVRQA PGKGLEWVSAISGSGGSTYYADFVKGRFTISRDNSKNTLYLQMNSL RAEDTAVYYCVSSVGAGAYYYQGLDVWGQGTLVTVSSASGGGGS GGGGSGGGGSHASDIQMTQSPSSLSASVGDRVTITCRASQGVGNFL AWYQQKPGKAPKLLIYGASTLQSGVPSRFSGSGSGTDFTLTISSLQP EDFATYYCQQSYSTPFTFGGGTKLEIKRAAAGSGSEQKLISEEDLGK PIPNPLLGLDST |
| DBA-cytokine complex | SEQ ID NO: 261 | MSTSTCDLPQTHSLGSRRTLMLLAQMRRISLFSCLKDRHDFGFPQE EFGNQFQKAETIPVLHEMIQQIFNLFSTKDSSAAWDETLLDKFYTEL YQQLNDLEACVIQGVGVTETPLMKEDSILAVRKYFQRITLYLKEKK YSPCAWEVVRAEIMRSFSLSTNLQESLRSKEGGSGSGSGGSGGSGS GGSGSEVQLLESGAEVKKPGGSLRLSCAASGFTFSSYAMSWVRQA PGKGLEWVSAISGSGGSTYYADSVKGRFTISRDNSKNTLYLQMNSL RAEDTAVYYCARVDSSSSLHFDYWGQGTLVTVSSASGGGGSGGG GSGGGGSHASDIQMTQSPSSLSASVGDRVTITCRASQRIGTYLNWY QQKPGKAPKLLIYAASNLQSGVPSRFSGSGSGTDFTLTISSLQPEDF ATYYCLQTFNTPFTFGPGTKVDIKRAAAGSGSEQKLISEEDLGKPIP NPLLGLDST |
| AF2589 | SEQ ID NO: 300 | MSTSTCDLPQTHSLGSRRTLMLLAQMRRISLFSCLKDRHDFGFPQEEFGNQFQKAE TIPVLHEMIQQIFNLFSTKDSSAAWDETLLDKFYTELYQQLNDLEACVIQGVGVTET PLMKEDSILAVRKYFQRITLYLKEKKYSPCAWEVVRAEIMRSFSLSTNLQESLRSKEG GGGSGGGGSGGGGSGGGGSQVQLVQSGAEVKKPGASVKVSCKASGYSFTSYDIN WVRQAPGQGLEWIGMINPSSGFTSAAQTFQGRVTMTRDTSTSTVYMELSSLRSE DTAVYYCATIKGLGAYYYYGMDVWGQGTTVTVSSASGGGGSGGGGSGGGGSHA SDIQMTQSPSSLSASVGDRVTITCRASQSIDRYLNWYQQKPGKAPKLLIYAASSLQS GVPSRFSGSGSGTDFTLTISSLQPEDFATYYCQQSYSPPLTFGGGTKVEIKGKPIPNPL LGLDST |
| AF2592 | SEQ ID NO: 301 | MSTSTCDLPQTHSLGSRRTLMLLAQMRRISLFSCLKDRHDFGFPQEEFGNQFQKAE TIPVLHEMIQQIFNLFSTKDSSAAWDETLLDKFYTELYQQLNDLEACVIQGVGVTET PLMKEDSILAVRKYFQRITLYLKEKKYSPCAWEVVRAEIMRSFSLSTNLQESLRSKEG GGGSGGGGSGGGGSGGGGSQVQLVQSGAEVKKPGASVKVSCKASGGTFSSYAIS WVRQAPGQGLEWMGWINPNSGGTNYAQKFQGRVTMTRDTSTSTVYMELSSLR SEDTAVYYCARSLFPTIFGVEVAFDIWGQGTTVTVSSASGGGGSGGGGSGGGGSH ASDIQMTQSPSSLSASVGDRVTITCRASQSIIDRLAWYQQKPGKAPKLLIYKASSLES GVPSRFSGSGSGTDFTLTISSLQPEDFATYYCQQSYSTPFTFGPGTKVDIKGKPIPNPL LGLDST |
| AF2594 | SEQ ID NO: 302 | MSTSTCDLPQTHSLGSRRTLMLLAQMRRISLFSCLKDRHDFGFPQEEFGNQFQKAE TIPVLHEMIQQIFNLFSTKDSSAAWDETLLDKFYTELYQQLNDLEACVIQGVGVTET PLMKEDSILAVRKYFQRITLYLKEKKYSPCAWEVVRAEIMRSFSLSTNLQESLRSKEG GGGSGGGGSGGGGSGGGGSEVQLVESGGGLVQPGGSLRLSCAASGFNIKDTYIH WVRQAPGKGLEWVARIYPTNGYTRYADSVKGRFTISADTSKNTAYLQMNSLRAED TAVYYCSRWGGDGFYAMDYWGQGTLVTVSSASGGGGSGGGGSGGGGSHASDI QMTQSPSSLSASVGDRVTITCRASQDVNTAVAWYQQKPGKAPKLLIYSASFLYSGV PSRFSGSRSGTDFTLTISSLQPEDFATYYCQQHYTTPPTFGQGTKVEIKGKPIPNPLL GLDST |

Example 33

Selection and Binding of LRRC15 and IFNα Specific Dual Binding Antibodies

This example describes isolation of sensor domains of the present disclosure, specifically, selection of LRRC15 and IFNα specific dual binding antibodies (DBAs). Anti-LRRC15 and anti-IFNα DBAs were isolated from dard protocols) and one round of LRRC15 selection (LRRC15-hFc, Sino Biologicals, 15786-H02H).

Figures 28A, 28B:
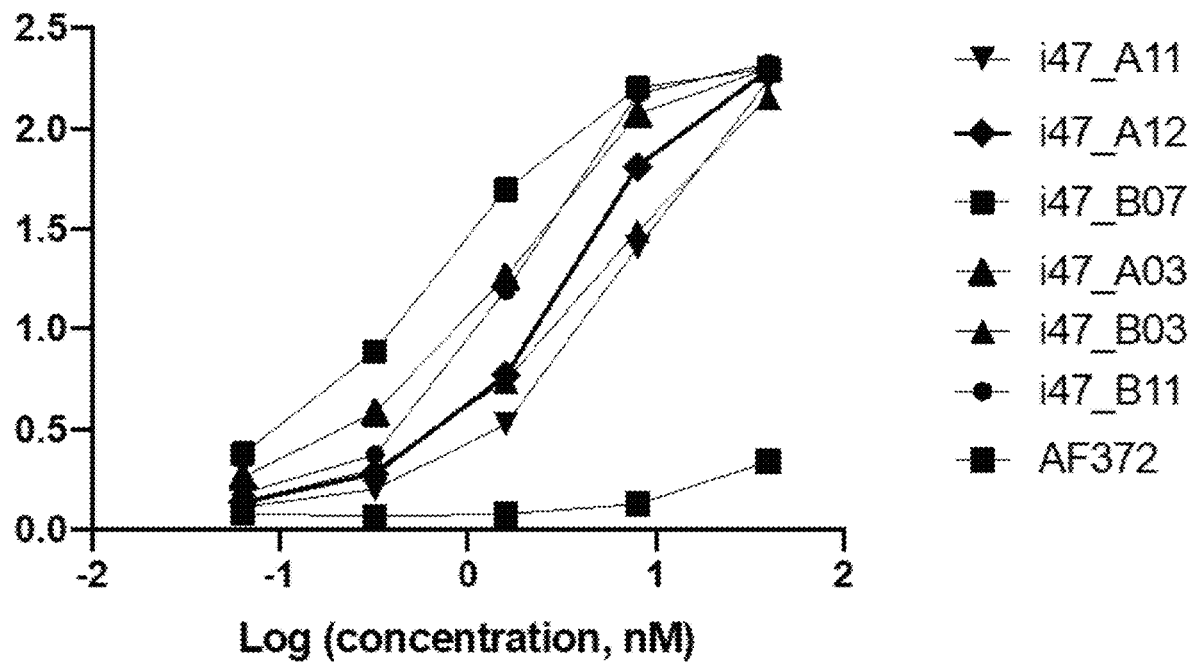
FIG. 28A provides ELISA binding data for six scFvs to LRRC15. Results from FIG. 28A are summarized in FIG. 28B.
Figure 29A:
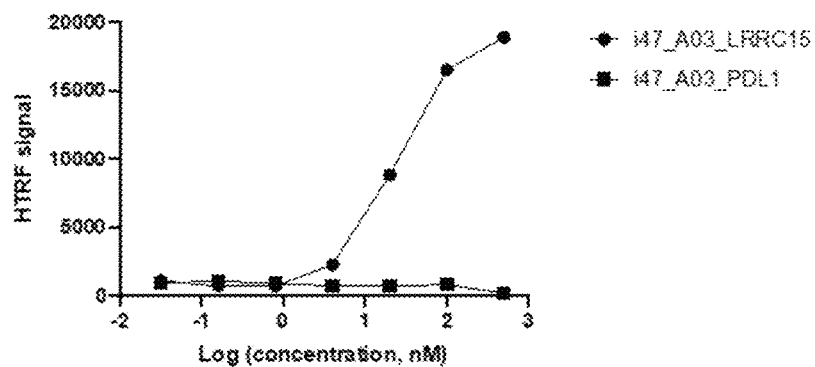
FIG. 29A-F summarize IFNAR2 binding by four LRRC15-IFN-α DBA-IFNα complexes and two control complexes.
Figure 29B:
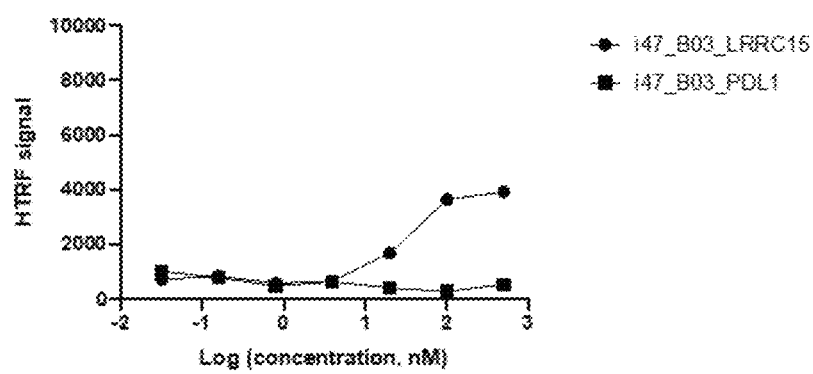
Figure 29C:
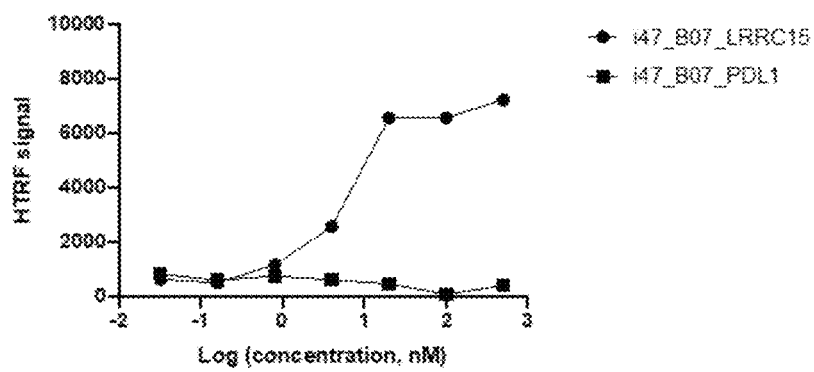
Figure 29D:
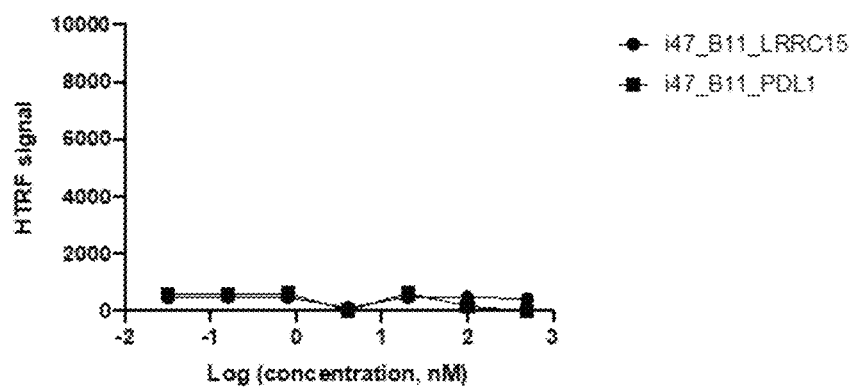
Figure 29E:
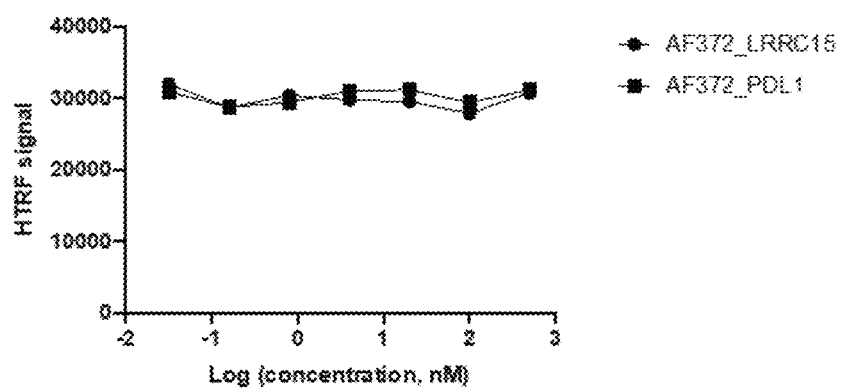
Figure 29F:
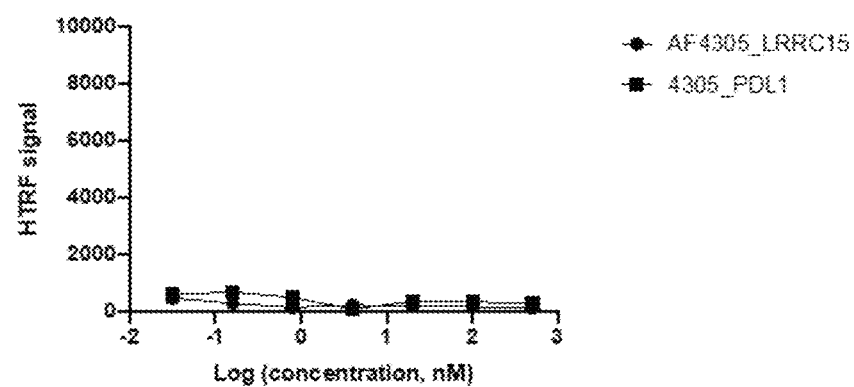

After a first round of selection in phage on 100 nM IFNα and a second round on 100 nM LRRC15, the resulting library of DBAs was subcloned into a yeast surface display vector and transformed into yeast for further screening using standard protocols. The yeast library was sorted four times for binding to LRRC15 and IFNα. In each round of sorting, the library was labeled with either LRRC15-Fc-biotin or IFNα-biotin, then with Streptavidin-PE (Abcam #ab239759) and sorted based on PE fluorescence on a Sony MA900 cell sorter. The four sorts were carried out with labelling at 100 nM LRRC15-Fc-biotin, 1000 nM IFNα-biotin, 10 nM LRRC15-Fc-biotin, and 10 nM LRRC15-Fc-biotin. Plasmids were rescued from the yeast after the final sort using a Zymoprep Yeast Plasmid Miniprep II kit (Zymo research D2004) and transformed into DH5a *E. coli* for cloning. Ninety-six colonies were picked for Sanger sequencing, from which twenty-four unique clones were identified and screened for IFNα and LRRC15 binding. The scFv DNA sequence for each clone, including c-myc and V5 tags, was amplified by PCR using a forward primer containing a T7 promoter and a translation initiation site, and a reverse primer containing a T7 terminator. Proteins were expressed using the PUREfrex2.1 cell-free transcription/translation system as described in previous examples. The scFv samples were subjected to ELISA analysis to detect LRRC15 and IFNα binding. FIG. 28A shows the ELISA binding data for six exemplary scFvs to LRRC15. Because the IFNα binding affinity was too low to detect by ELISA for some scFvs, the binding to IFNα was also measured by Biolayer Interferometry (OctetRED96e) as described in Example 5. Results and antibody sequences are tabulated in FIG. 28B. All six show binding to both LRRC15 and IFNα, with binding to LRRC15 detectable at a lower concentration of the antigen. Protein complex sequences are provided in TABLE 31.

TABLE 31

| | DBA-cytokine protein complexes, and control protein complexes | |
|---|---|---|
| Protein Complex | SEQ ID NO: | Sequence |
| A03 | SEQ ID NO: 262 | MSTSTQVQLVQSGAEVKKPGASVKVSCKASGYTFTGYYMHWVRQAPGQGLEW MGWMDPNNDDADYAQRFQGRVTMTRDTSTSTVYMELSSLRSEDTAVYYCASLA AAGPYYYYGMDVWGQGTLVTVSSASGGGGSGGGGSGGGGSHASDIQMTQSPS SLSASVGDRVTITCRASQSINNYLNWYQQKPGKAPKLLIYGASNLETGVPSRFSGSG SGTDFTLTISSLQPEDFATYYCQQSYGTPLTFGGGTKVEIKRAAAGSGSEQKLISEED LGKPIPNPLLGLDST |
| i47_A11 | SEQ ID NO: 314 | MSTSTQVQLVQSGAEVKKPGSSVKVSCKASGYTFTSYDINWVRQA PGQGLEWMGTINPSDGDTTYAQKFQGRVTITADESTSTAYMELSSL RSEDTAVYYCARVGGWGIYYYYGMDVWGQGTLVTVSSASGGGG SGGGGSGGGGSHASDIQMTQSPSSLSASVGDRVTITCRASQSINSW LAWYQQKPGKAPKLLIYAASSLQSGVPSRFSGSGSGTDFTLTISSLQ PEDFATYYCQQTYTVPFSFGQGTKLEIKRAAAGSGSEQKLISEEDLG KPIPNPLLGLDST |
| i47_A12 | SEQ ID NO: 315 | MSTSTQVQLVQSGAEVKKPGSSVKVSCKASGYTFINNDINWVRQA PGQGLEWMGGTIPIFGVHIYAQKFQGRVTITADESTSTAYMELSSL RSEDTAVYYCVSSVGAGAYYYYGMDVWGQGTLVTVSSASGGGG SGGGGSGGGGSHASDIQMTQSPSSLSASVGDRVTITCQASQDISNY LNWYQQKPGKAPKLLIYAASSLQSGVPSRFSGSGSGTDFTLTISSLQ PEDFATYYCQQSYSLPYTFGQGTRLEIKRAAAGSGSEQKLISEEDLG KPIPNPLLGLDST |
| B03 | SEQ ID NO: 263 | MSTSTQVQLVQSGAEVKKPGASVEVSCKASGGTFSSYAINWVRQAPGQGLEWM GWIDPKSGDTTYAQKFQGRVTMTRDTSTSTVYMELSSLRSEDTAVYYCASGGSYSP WYFDLWGQGTLVTVSSASGGGGSGGGGSGGGGSHASDIQMTQSPSSLSASVGD RVTITCRASQSISSWLAWYQQKSGKAPKLLIYAASSLQSGVPSRFSGSGSGTDFLTI SSLQPEDFATYYCQQAYSFPFTFGPGTKVDIKRAAAGSGSEQKLISEEDLGKPIPNPL LGLDST |
| B07 | SEQ ID NO: 264 | MSTSTQVQLVQSGAEVKKPGASVKVSCKASGYTFTGYYMHWVRQAPGQGLEW MGWMDPNNDDADYAQRFQGRVTMTRDTSTSTVYMELSSLRSEDTAVYYCASLA AAGPYYYYGMDVWGQGTLVTVSSASGGGGSGGGGSGGGGSHASDIQMTQSPS SLSASVGDRVTITCQASQDISNYLNWYQQKPGKAPKLLIYGASILEAGVPSRFSGSG SGTDFTLTISSLQPEDFATYYCQQSYSAPITFGQGTRLEIKRAAAGSGSEQKLISEEDL GKPIPNPLLGLDST |
| B11 | SEQ ID NO: 265 | MSTSTQVQLVQSGAEVKKPGSSVKVSCKASGYTFTSYDINWVRQAPGQGLEWLG GTVPLFGISHYAQKFQGRVTITADESTSTAYMELSSLRSEDTAVYYCVSSVGAGAYY YQGLDVWGQGTLVTVSSASGGGGSGGGGSGGGGSHASDIQMTQSPSSLSASVG DRVTITCRASQSISSYLNWYQQKPGKAPKLLIYAASSLQSGVPSRFSGSGSGTDFLT ISSLLPEDFATYYCQQSYLPPYSFGQGTKLEIKRAAAGSGSEQKLISEEDLGKPIPNPLL GLDST |
| AF372 | SEQ ID NO: 258 | MSTSTEQKLISEEDLEVQLVESGGGLVQPGGSLRLSCAASGFNIKDTYIHWVRQAP GKGLEWVARIYPTNGYTRYADSVKGRFTISADTSKNTAYLQMNSLRAEDTAVYYCS RWGGDGFYAMDYWGQGTLVTVSSASGGGGSGGGGSGGGGSHASDIQMTQSP SSLSASVGDRVTITCRASQDVNTAVAWYQQKPGKAPKLLIYSASFLYSGVPSRFSGS RSGTDFTLTISSLQPEDFATYYCQQHYTTPPTFGQGTKVEIKGSGLNDIFEAQKIEW HEGKPIPNPLLGLDST |

Example 34

Regulated IFNAR2 (IFNα Receptor 2) Binding by a LRRC15-IFNα Dual Binding Antibody (DBA) Cytokine Complex This example describes LRRC15 dependent binding of IFN to the receptor IFNAR2 by LRRC15/IFN DBA-cytokine complexes. The cytokine complexes of this example are composed of a LRRC15-IFN-αL DBA IgG with IFN-α linked to the N-terminus of one heavy chain (a schematic of the structure is shown in FIG. 9B). DBA-cytokine complexes AF4581 (SEQ ID NO: 266-268), AF4586 (SEQ TD NO: 269-271), AF4587 (SEQ TD NO: 266-267, 272) and AF4588 (SEQ TD NO: 273-275) were chosen for analysis. Two cytokine complexes with the same structure were included as controls: AF4305 (SEQ TD NO: 294-296), which is based on a neutralizing anti-IFNα antibody, and AF4306 (SEQ TD NO: 64, 192, 297), which is based on an anti-Her2 antibody. Protein complex sequences are provided in TABLE 32. The six IgG-cytokines were expressed in mammalian cells using standard protocols and added to a 384 well plate at a single dilution. Titrating concentrations of either LRRC15-Fc (SINO Biological), PDL1-Fc (ACRO-Biosystems) or CEA-Fc (SINO Biological) were added, and the plate was incubated for 30 minutes at room temperature. Eu-labeled IFNAR2 (ACROBiosystems) and Alexa Fluor 647-labeled anti-V5 antibody (Perkin Elmer) were added to all wells and incubated for 24 hours at room temperature. The HTRF signal was then read on an Envision 2105 microplate reader (Perkin Elmer). Results shown in FIGS. 29A-F demonstrate IFNAR2 binding increased in a dose dependent manner with the addition of LRRC15 but not with the addition of control protein PDL1 for DBA-cytokine complexes of AF4581, AF4586 and AF4587, demonstrating LRRC15-dependent regulation of IFNAR-binding activity. IFNAR2 binding from AF4588 and the monospecific IFN scFv cytokine complexes AF4305 and AF4306 did not change with the addition of LRRC15 or PD-L1.

While preferred embodiments of the present disclosure have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein may be employed in practicing the disclosure. It is intended that the following claims define the scope of the disclosure and that methods and structures within the scope of these claims and their equivalents be covered thereby.

TABLE 32

DBA-cytokine protein complexes, and control protein complexes

| Protein Complex | SEQ ID NO: | Sequence |
|---|---|---|
| AF4581 | SEQ ID NO: 266 | CDLPQTHSLGSRRTLMLLAQMRRISLFSCLKDRHDFGFPQEEFGNQFQKAETIPVL HEMIQQIFNLFSTKDSSAAWDETLLDKFYTELYQQLNDLEACVIQGVGVTETPLMK EDSILAVRKYFQRITLYLKEKKYSPCAWEVVRAEIMRSFSLSTNLQESLRSKEGGGGS GGGGSGGGGSGGGGSQVQLVQSGAEVKKPGASVKVSCKASGYTFTGYYMHWV RQAPGQGLEWMGWMDPNNDDADYAQRFQGRVTMTRDTSTSTVYMELSSLRS EDTAVYYCASLAAAGPYYYYGMDVWGQGTLVTVSSAKTTAPSVYPLAPVCGDTTG SSVTLGCLVKGYFPEPVTLTWNSGSLSSGVHTFPAVLQSDLYTLSSSVTVTSSTWPS QSITCNVAHPASSTKVDKKIEPRGPTIKPCPPCKCPAPNAAGGPSVFIFPPKIKDVLM ISLSPIVTCVVVDVSEDDPDVQISWFVNNVEVHTAQTQTHREDYNSTLRVVSALPI QHQDWMSGKEFKCKVNNKDLGAPIERTISKPKGSVRAPQVYVLPPPEEEMTKKQ VTLTCMVTDFMPEDIYVEWTNNGKTELNYKNTEPVLDSDGSYFMYSDLRVEKKN WVERNSYSCSVVHEGLHNHHTTESFSRTPGK |
| | SEQ ID NO: 267 | QVQLVQSGAEVKKPGASVKVSCKASGYTFTGYYMHWVRQAPGQGLEWIVIGWIVI DPNNDDADYAQRFQGRVTMTRDTSTSTVYMELSSLRSEDTAVYYCASLAAAGPYY YYGMDVWGQGTLVTVSSAKTTAPSVYPLAPVCGDTTGSSVTLGCLVKGYFPEPVTL TWNSGSLSSGVHTFPAVLQSDLYTLSSSVTVTSSTWPSQSITCNVAHPASSTKVDKK lEPRGPTIKPCPPCKCPAPNAAGGPSVFIFPPKIKDVLMISLSPIVTCVVVDVSEDDPD VQISWFVNNVEVHTAQTQTHREDYNSTLRVVSALPIQHQDWMSGKEFKCKVNN KDLGAPIERTISKPKGSVRAPQVYVLPPPEKEMTKKQVSLTCLVKDFIVIPEDIYVEWT NNGKTELNYKNTEPVLKSDGSYFMYSKLTVEKKNWVERNSYSCSVVHEGLHNHHT TKSFSRTPGK |
| | SEQ ID NO: 268 | DIQMTQSPSSLSASVGDRVTITCRASQSINNYLNWYQQKPGKAPKLLIYGASNLET GVPSRFSGSGSGTDFTLTISSLQPEDFATYYCQQSYGTPLTFGGGTKVEIKRADAAPT VSIFPPSSEQLTSGGASVVCFLNNFYPKDINVKWKIDGSERQNGVLNSWTDQDSK DSTYSMSSTLTLTKDEYERHNSYTCEATHKTSTSPIVKSFNRNEC |
| AF4586 | SEQ ID NO: 269 | CDLPQTHSLGSRRTLMLLAQMRRISLFSCLKDRHDFGFPQEEFGNQFQKAETIPVL HEMIQQIFNLFSTKDSSAAWDETLLDKFYTELYQQLNDLEACVIQGVGVTETPLMK EDSILAVRKYFQRITLYLKEKKYSPCAWEVVRAEIMRSFSLSTNLQESLRSKEGGGGS GGGGSGGGGSGGGGSQVQLVQSGAEVKKPGASVEVSCKASGGTFSSYAINWVR QAPGQGLEWMGWIDPKSGDTTYAQKFQGRVTMTRDTSTSTVYMELSSLRSEDT AVYYCASGGSYSPWYFDLWGQGTLVTVSSAKTTAPSVYPLAPVCGDTTGSSVTLG CLVKGYFPEPVTLTWNSGSLSSGVHTFPAVLQSDLYTLSSSVTVTSSTWPSQSITCN VAHPASSTKVDKKIEPRGPTIKPCPPCKCPAPNAAGGPSVFIFPPKIKDVLMISLSPIV TCVVVDVSEDDPDVQISWFVNNVEVHTAQTQTHREDYNSTLRVVSALPIQHQDW MSGKEFKCKVNNKDLGAPIERTISKPKGSVRAPQVYVLPPPEEEMTKKQVTLTCMV TDFMPEDIYVEWTNNGKTELNYKNTEPVLDSDGSYFMYSDLRVEKKNWVERNSYS CSVVHEGLHNHHTTESFSRTPGK |

TABLE 32-continued DBA-cytokine protein complexes, and control protein complexes

| Protein Complex | SEQ ID NO: | Sequence |
|---|---|---|
| | SEQ ID NO: 270 | QVQLVQSGAEVKKPGASVEVSCKASGGTFSSYAINWVRQAPGQGLEWMGWIDP KSGDTTYAQKFQGRVTMTRDTSTSTVYMELSSLRSEDTAVYYCASGGSYSPWYFDL WGQGTLVTVSSAKTTAPSVYPLAPVCGDTTGSSVTLGCLVKGYFPEPVTLTWNSGS LSSGVHTFPAVLQSDLYTLSSSVTVTSSTWPSQSITCNVAHPASSTKVDKKIEPRGPT IKPCPPCKCPAPNAAGGPSVFIFPPKIKDVLMISLSPIVTCVVVDVSEDDPDVQISWF VNNVEVHTAQTQTHREDYNSTLRVVSALPIQHQDWMSGKEFKCKVNNKDLGAPI ERTISKPKGSVRAPQVYVLPPPEKEMTKKQVSLTCLVKDFMPEDIYVEWTNNGKTE LNYKNTEPVLKSDGSYFMYSKLTVEKKNWVERNSYSCSVVHEGLHNHHTTKSFSRT PGK |
| | SEQ ID NO: 271 | DIQMTQSPSSLSASVGDRVTITCRASQSISSWLAWYQQKSGKAPKLLIYAASSLQSG VPSRFSGSGSGTDFTLTISSLQPEDFATYYCQQAYSFPFTFGPGTKVDIKRADAAPTV SIFPPSSEQLTSGGASVVCFLNNFYPKDINVKWKIDGSERQNGVLNSWTDQDSKDS TYSMSSTLTLTKDEYERHNSYTCEATHKTSTSPIVKSFNRNEC |
| AF4587 | SEQ ID NO: 266 | CDLPQTHSLGSRRTLMLLAQMRRISLFSCLKDRHDFGFPQEEFGNQFQKAETIPVL HEMIQQIFNLFSTKDSSAAWDETLLDKFYTELYQQLNDLEACVIQGVGVTETPLMK EDSILAVRKYFQRITLYLKEKKYSPCAWEVVRAEIMRSFSLSTNLQESLRSKEGGGGS GGGGSGGGGSGGGGSQVQLVQSGAEVKKPGASVKVSCKASGYTFTGYYMHWV RQAPGQGLEWMGWMDPNNDDADYAQRFQGRVTMTRDTSTSTVYMELSSLRS EDTAVYYCASLAAAGPYYYYGMDVWGQGTLVTVSSAKTTAPSVYPLAPVCGDTTG SSVTLGCLVKGYFPEPVTLTWNSGSLSSGVHTFPAVLQSDLYTLSSSVTVTSSTWPS QSITCNVAHPASSTKVDKKIEPRGPTIKPCPPCKCPAPNAAGGPSVFIFPPKIKDVLM ISLSPIVTCVVVDVSEDDPDVQISWFVNNVEVHTAQTQTHREDYNSTLRVVSALPI QHQDWMSGKEFKCKVNNKDLGAPIERTISKPKGSVRAPQVYVLPPPEEEMTKKQ VTLTCMVTDFMPEDIYVEWTNNGKTELNYKNTEPVLDSDGSYFMYSDLRVEKKN WVERNSYSCSVVHEGLHNHHTTESFSRTPGK |
| | SEQ ID NO: 267 | QVQLVQSGAEVKKPGASVKVSCKASGYTFTGYYMHWVRQAPGQGLEWMGWM DPNNDDADYAQRFQGRVTMTRDTSTSTVYMELSSLRSEDTAVYYCASLAAAGPYY YYGMDVWGQGTLVTVSSAKTTAPSVYPLAPVCGDTTGSSVTLGCLVKGYFPEPVTL TWNSGSLSSGVHTFPAVLQSDLYTLSSSVTVTSSTWPSQSITCNVAHPASSTKVDKK IEPRGPTIKPCPPCKCPAPNAAGGPSVFIFPPKIKDVLMISLSPIVTCVVVDVSEDDPD VQISWFVNNVEVHTAQTQTHREDYNSTLRVVSALPIQHQDWMSGKEFKCKVNN KDLGAPIERTISKPKGSVRAPQVYVLPPPEKEMTKKQVSLTCLVKDFMPEDIYVEWT NNGKTELNYKNTEPVLKSDGSYFMYSKLTVEKKNWVERNSYSCSVVHEGLHNHHT TKSFSRTPGK |
| | SEQ ID NO: 272 | DIQMTQSPSSLSASVGDRVTITCQASQDISNYLNWYQQKPGKAPKLLIYGASILEAG VPSRFSGSGSGTDFTLTISSLQPEDFATYYCQQSYSAPITFGQGTRLEIKRADAAPTV SIFPPSSEQLTSGGASVVCFLNNFYPKDINVKWKIDGSERQNGVLNSWTDQDSKDS TYSMSSTLTLTKDEYERHNSYTCEATHKTSTSPIVKSFNRNEC |
| AF4588 | SEQ ID NO: 273 | CDLPQTHSLGSRRTLMLLAQMRRISLFSCLKDRHDFGFPQEEFGNQFQKAETIPVL HEMIQQIFNLFSTKDSSAAWDETLLDKFYTELYQQLNDLEACVIQGVGVTETPLMK EDSILAVRKYFQRITLYLKEKKYSPCAWEVVRAEIMRSFSLSTNLQESLRSKEGGGGS GGGGSGGGGSGGGGSQVQLVQSGAEVKKPGSSVKVSCKASGYTFTSYDINWVRQ APGQGLEWLGGTVPLFGISHYAQKFQGRVTITADESTSTAYMELSSLRSEDTAVYY CVSSVGAGAYYYQGLDVWGQGTLVTVSSAKTTAPSVYPLAPVCGDTTGSSVTLGC LVKGYFPEPVTLTWNSGSLSSGVHTFPAVLQSDLYTLSSSVTVTSSTWPSQSITCNV AHPASSTKVDKKIEPRGPTIKPCPPCKCPAPNAAGGPSVFIFPPKIKDVLMISLSPIVT CVVVDVSEDDPDVQISWFVNNVEVHTAQTQTHREDYNSTLRVVSALPIQHQDW MSGKEFKCKVNNKDLGAPIERTISKPKGSVRAPQVYVLPPPEEEMTKKQVTLTCMV TDFMPEDIYVEWTNNGKTELNYKNTEPVLDSDGSYFMYSDLRVEKKNWVERNSYS CSVVHEGLHNHHTTESFSRTPGK |
| | SEQ ID NO: 274 | QVQLVQSGAEVKKPGSSVKVSCKASGYTFTSYDINWVRQAPGQGLEWLGGTVPL FGISHYAQKFQGRVTITADESTSTAYMELSSLRSEDTAVYYCVSSVGAGAYYYQGLD VWGQGTLVTVSSAKTTAPSVYPLAPVCGDTTGSSVTLGCLVKGYFPEPVTLTWNS GSLSSGVHTFPAVLQSDLYTLSSSVTVTSSTWPSQSITCNVAHPASSTKVDKKIEPRG PTIKPCPPCKCPAPNAAGGPSVFIFPPKIKDVLMISLSPIVTCVVVDVSEDDPDVQIS WFVNNVEVHTAQTQTHREDYNSTLRVVSALPIQHQDWMSGKEFKCKVNNKDLG APIERTISKPKGSVRAPQVYVLPPPEKEMTKKQVSLTCLVKDFMPEDIYVEWTNNG KTELNYKNTEPVLKSDGSYFMYSKLTVEKKNWVERNSYSCSVVHEGLHNHHTTKSF SRTPGK |
| | SEQ ID NO: 275 | DIQMTQSPSSLSASVGDRVTITCRASQSISSYLNWYQQKPGKAPKLLIYAASSLQSG VPSRFSGSGSGTDFTLTISSLLPEDFATYYCQQSYLPPYSFGQGTKLEIKRADAAPTVS IFPPSSEQLTSGGASVVCFLNNFYPKDINVKWKIDGSERQNGVLNSWTDQDSKDST YSMSSTLTLTKDEYERHNSYTCEATHKTSTSPIVKSFNRNEC |
| AF4305 | SEQ ID NO: 294 | CDLPQTHSLGSRRTLMLLAQMRRISLFSCLKDRHDFGFPQEEFGNQFQKAETIPVL HEMIQQIFNLFSTKDSSAAWDETLLDKFYTELYQQLNDLEACVIQGVGVTETPLMK EDSILAVRKYFQRITLYLKEKKYSPCAWEVVRAEIMRSFSLSTNLQESLRSKEGGGGS GGGGSGGGGSGGGGSQVQLVQSGAEVKKPGSSVKVSCKASGYTFTAYDINWVR QAPGQGLEWVGIINPGSGSPMYAQKFQGRVTITADESTSTAYMELSSLRSEDTAV YYCQSSVGAGAYYYQGLDVWGQGTLVTVSSAKTTAPSVYPLAPVCGDTTGSSVTL GCLVKGYFPEPVTLTWNSGSLSSGVHTFPAVLQSDLYTLSSSVTVTSSTWPSQSITC NVAHPASSTKVDKKIEPRGPTIKPCPPCKCPAPNAAGGPSVFIFPPKIKDVLMISLPI VTCVVVDVSEDDPDVQISWFVNNVEVHTAQTQTHREDYNSTLRVVSALPIQHQD |

TABLE 32-continued

DBA-cytokine protein complexes, and control protein complexes

| Protein Complex | SEQ ID NO: | Sequence |
|---|---|---|
| | SEQ ID NO: 295 | WMSGKEFKCKVNNKDLGAPIERTISKPKGSVRAPQVYVLPPPEEEMTKKQVTLTC MVTDFMPEDIYVEWTNNGKTELNYKNTEPVLDSDGSYFMYSDLRVEKKNWVERN SYSCSVVHEGLHNHHTTESFSRTPGK QVQLVQSGAEVKKPGSSVKVSCKASGYTFTAYDINWVRQAPGQGLEWVGIINPGS GSPMYAQKFQGRVTITADESTSTAYMELSSLRSEDTAVYYCVSSVGAGAYYYQGLD VWGQGTLVTVSSAKTTAPSVYPLAPVCGDTTGSSVTLGCLVKGYFPEPVTLTWNS GSLSSGVHTFPAVLQSDLYTLSSSVTVTSSTWPSQSITCNVAHPASSTKVDKKIEPRG PTIKPCPPCKCPAPNAAGGPSVFIFPPKIKDVLMISLSPIVTCVVVDVSEDDPDVQIS WFVNNVEVHTAQTQTHREDYNSTLRVVSALPIQHQDWMSGKEFKCKVNNKDLG APIERTISKPKGSVRAPQVYVLPPPEKEMTKKQVSLTCLVKDFMPEDIYVEWTNNG KTELNYKNTEPVLKSDGSYFMYSKLTVEKKNWVERNSYSCSVVHEGLHNHHTTKSF SRTPGGGGSGGGSHHHHHH |
| | SEQ ID NO: 296 | DIQMTQSPSSLSASVGDRVTITCQASQDIANYLNWYQQKPGKAPKLLIYSASNLQS GVPSRFSGSGSGTDFTLTISSLQPEDFATYYCQQSYSTQWTFGQGTKVEIKRADAA PTVSIFPPSSEQLTSGGASVVCFLNNFYPKDINVKWKIDGSERQNGVLNSWTDQDS KDSTYSMSSTLTLTKDEYERHNSYTCEATHKTSTSPIVKSFNRNEC |
| AF4306 | SEQ ID NO: 64 | DIQMTQSPSSLSASVGDRVTITCRASQDVNTAVAWYQQKPGKAPKLLIYSASFLYS GVPSRFSGSRSGTDFTLTISSLQPEDFATYYCQQHYTTPPTFGQGTKVEIKRADAAP TVSIFPPSSEQLTSGGASVVCFLNNFYPKDINVKWKIDGSERQNGVLNSWTDQDSK DSTYSMSSTLTLTKDEYERHNSYTCEATHKTSTSPIVKSFNRNEC |
| | SEQ ID NO: 192 | EVQLVESGGGLVQPGGSLRLSCAASGFNIKDTYIHWVRQAPGKGLEWVARIYPTNGYTRY ADSVKGRFTISADTSKNTAYLQMNSLRAEDTAVYYCSRWGGDGFYAMDYWGQGTLVTVS SAKTTAPSVYPLAPVCGDTTGSSVTLGCLVKGYFPEPVTLTWNSGSLSSGVHTFPAVLQSDL YTLSSSVTVTSSTWPSQSITCNVAHPASSTKVDKKIEPRGPTIKPCPPCKCPAPNAAGGPSVF IFPPKIKDVLMISLSPIVTCVVVDVSEDDPDVQISWFVNNVEVHTAQTQTHREDYNSTLRVV SALPIQHQDWMSGKEFKCKVNNKDLGAPIERTISKPKGSVRAPQVYVLPPPEKEMTKKQV SLTCLVKDFMPEDIYVEWTNNGKTELNYKNTEPVLKSDGSYFMYSKLTVEKKNWVERNSYS CSVVHEGLHNHHTTKSFSRTPGGGGSGGGSHHHHHH |
| | SEQ ID NO: 297 | CDLPQTHSLGSRRTLMLLAQMRRISLFSCLKDRHDFGFPQEEFGNQFQKAETIPVL HEMIQQIFNLFSTKDSSAAWDETLLDKFYTELYQQLNDLEACVIQGVGVTETPLMK EDSILAVRKYFQRITLYLKEKKYSPCAWEVVRAEIMRSFSLSTNLQESLRSKEGGGGS GGGGSGGGGSGGGGSEVQLVESGGGLVQPGGSLRLSCAASGFNIKDTYIHWVRQ APGKGLEWVARIYPTNGYTRYADSVKGRFTISADTSKNTAYLQMNSLRAEDTAVYY CSRWGGDGFYAMDYWGQGTLVTVSSAKTTAPSVYPLAPVCGDTTGSSVTLGCLV KGYFPEPVTLTWNSGSLSSGVHTFPAVLQSDLYTLSSSVTVTSSTWPSQSITCNVAH PASSTKVDKKIEPRGPTIKPCPPCKCPAPNAAGGPSVFIFPPKIKDVLMISLSPIVTCV VVDVSEDDPDVQISWFVNNVEVHTAQTQTHREDYNSTLRVVSALPIQHQDWMS GKEFKCKVNNKDLGAPIERTISKPKGSVRAPQVYVLPPPEEEMTKKQVTLTCMVTD FMPEDIYVEWTNNGKTELNYKNTEPVLDSDGSYFMYSDLRVEKKNWVERNSYSCS VVHEGLHNHHTTESFSRTPGK |

SEQUENCE LISTING (328 sequences)

SEQ ID NO: 1 - protein, 14 aa, Artificial Sequence
  Description of Artificial Sequence: Synthetic peptide
  PDL1_DB01_F08 HCDR3
CARDRIAVAGFDYW

SEQ ID NO: 2 - protein, 13 aa, Artificial Sequence
  Description of Artificial Sequence: Synthetic peptide
  PDL1_DB02_A08 HCDR3
CAKEVFSGWYDYW

SEQ ID NO: 3 - protein, 17 aa, Artificial Sequence
  Description of Artificial Sequence: Synthetic peptide
  PDL1_DB02_D10 HCDR3
CTTDLLSLELDDAFDIW

SEQ ID NO: 4 - protein, 19 aa, Artificial Sequence
  Description of Artificial Sequence: Synthetic peptide
  PDL1_DB03_G11 HCDR3
CARSLFPTIFGVEVAFDIW

SEQ ID NO: 5 - protein, 14 aa, Artificial Sequence
  Description of Artificial Sequence: Synthetic peptide
  PDL1_DB03_H02 HCDR3
CARDSYYYDSFDYW

SEQ ID NO: 6 - protein, 16 aa, Artificial Sequence
  Description of Artificial Sequence: Synthetic peptide
  PDL1_DB04_A07 HCDR3
CARHGEWGSGWPFDYW

SEQ ID NO: 7 - protein, 21 aa, Artificial Sequence
  Description of Artificial Sequence: Synthetic peptide
  PDL1_DB04_B08 HCDR3
CARDLLPAIFSGEVNDAFDIW

SEQ ID NO: 8 - protein, 14 aa, Artificial Sequence
  Description of Artificial Sequence: Synthetic peptide
  PDL1_DB04_B09 HCDR3
CARETIAVAGFDPW

SEQ ID NO: 9 - protein, 20 aa, Artificial Sequence
  Description of Artificial Sequence: Synthetic peptide
  PDL1_DB04_F02 HCDR3
CARDVLPTIFGVVSDAFDIW

SEQ ID NO: 10 - protein, 13 aa, Artificial Sequence [sequence omitted]

SEQ ID NO: 11 - protein, 8 aa, Artificial Sequence
  Description of Artificial Sequence: Synthetic peptide
  PD1_R04_C10
CAAGLFIW

SEQ ID NO: 12 - protein, 8 aa, Artificial Sequence
  Description of Artificial Sequence: Synthetic peptide
  PD1-R15-B02
CAGGWLDW

SEQ ID NO: 13 - protein, 13 aa, Artificial Sequence
  Description of Artificial Sequence: Synthetic peptide
  PD1-R07-D03
CARDHLGGSYQPW

SEQ ID NO: 14 - protein, 28 aa, Artificial Sequence
  Description of Artificial Sequence: Synthetic peptide
  PD1-R07-C09
CARDLVGVSPGINYVPRYYYYYYGMDVW

SEQ ID NO: 15 - protein, 19 aa, Artificial Sequence
  Description of Artificial Sequence: Synthetic peptide
  PD1-R07-D05
CARDTGLGYYYGSGDFDYW

SEQ ID NO: 16 - protein, 15 aa, Artificial Sequence
  Description of Artificial Sequence: Synthetic peptide
  PD1-R07-D06
CARSGYSYGYYFDYW

SEQ ID NO: 17 - protein, 13 aa, Artificial Sequence
  Description of Artificial Sequence: Synthetic peptide
  PD1-R07-E05
CARTGGYPAIDSW

SEQ ID NO: 18 - protein, 8 aa, Artificial Sequence
  Description of Artificial Sequence: Synthetic peptide
  PD1-R07-A05
CASGWDVW

SEQ ID NO: 19 - protein, 12 aa, Artificial Sequence
  Description of Artificial Sequence: Synthetic peptide
  PD1-R07-G12
CASSPLQWVDVW

SEQ ID NO: 20 - protein, 8 aa, Artificial Sequence
  Description of Artificial Sequence: Synthetic peptide
  PD1-R07-A10
CTSGMDVW

SEQ ID NO: 21 - protein, 245 aa, Artificial Sequence
  Description of Artificial Sequence: Synthetic polypeptide
  PDL1-IFN-R01-A05
QVQLVQSGAEVKKPGASVKVSCKASGYTFSNYYIHWVRQAPGQGLEWMGWMDSNSGGTGYAQKFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 22 - protein, 251 aa, Artificial Sequence
  Description of Artificial Sequence: Synthetic polypeptide
  PDL1-IFN-R01-A06
QVQLVQSGAEVKKPGASVKVSCKASGGTFSSYAISWVRQAPGQGLEWVGWMDPKSGNTGYAQKFQGRVTMTRDTSTSTVYMELSSLRSEDTAVYYCARSLFPTIFGVEVAFDIWGQGTLVTVSSASGGGGSGGGGSGGGGSHASDIQMTQSPSSLSASVGDRVTITCQASQDINNYLNWYQQKPGKAPKLLIYKASSLEPGVPSRFSGSGSGTDFTLTISSLQPEDFATYYCQKSNDVPFTFGQGTKVEIK

SEQ ID NO: 23 - protein, 251 aa, Artificial Sequence
  Description of Artificial Sequence: Synthetic polypeptide
  PDL1-IFN-R01-A11
QVQLVQSGAEVKKPGASVKVSCKASGGTFSSYYMHWVRQAPGQGLEWMGWMNPNSGNTGYAQKFQGRVTMTRDTSTSTVYMELSSLRSEDTAVYYCARSLFPTIFGVEVAFDIWGQGTLVTVSSASGGGGSGGGGSGGGGSHASDIQMTQSPSSLSASVGDRVTITCQASQDITNYLNWYQQKPGKAPKLLIYAASSLESGVPSRFSGSGSGTDFTLTISSLQPEDFATYYCQQSYSIPITFGQGTRLEIK

SEQ ID NO: 24 - protein, 251 aa, Artificial Sequence
  Description of Artificial Sequence: Synthetic polypeptide
  PDL1-IFN-R01-B09
QVQLVQSGAEVKKPGASVKVSCKASGGTFTGYYMHWVRQAPGQGLEWMGWVNPNSGNTGYAQKFQGRVTMTRDTSTSTVYMELSSLRSEDTAVYYCARSLFPTIFGVEVAFDIWGQGTLVTVSSASGGGGSGGGGSGGGGSHASDIQMTQSPSSLSASVGDRVTITCQASQDISNYLNWYQQKPGKAPKLLIYAASSLQSGVPSRFSGSGSGTDFTLTISSLQPEDFATYYCQQSYSPPPTFGQGTKLEIK

SEQ ID NO: 25 - protein, 251 aa, Artificial Sequence
  Description of Artificial Sequence: Synthetic polypeptide
  PDL1-IFN-R01-B12
QVQLVQSGAEVKKPGASVKVSCKASGNTFTDYYMHWVRQAPGQGLEWMGWMNPNSGNTGYAQKFQGRVTMTRDTSTSTVYMELSSLRSEDTAVYYCARSLFPTIFGVEVAFDIWGQGTLVTVSSASGGGGSGGGGSGGGGSHASDIQMTQSPSSLSASVGDRVTITCQASQDISNYLNWYQQKPGKAPKLLIYAASSLQSGVPSRFSGSGSGTDFTLTISSLQPEDFATYYCQQSYSTPPTFGQGTRLEIK

SEQ ID NO: 26 - protein, 251 aa, Artificial Sequence
  Description of Artificial Sequence: Synthetic polypeptide
  PDL1-IFN-R01-C08
QVQLVQSGAEVKKPGASVKVSCKASGGTFSSYAISWVRQAPGQGLEWMGIIDPSVTYTRYAQKFQGRVTMTRDTSTSTVYMELSSLRSEDTAVYYCARSLFPTIFGVEVAFDIWGQGTLVTVSSASGGGGSGGGGSGGGGSHASDIQMTQSPSSLSASVGDRVTITCQASQDISNYLNWYQQKPGKAPKLLIYGASTLQSGVPSRFSGSGSGTDFTLTISSLQPEDFATYYCQQTYSTPITFGQGTKVEIK

SEQ ID NO: 27 - protein, 251 aa, Artificial Sequence
  Description of Artificial Sequence: Synthetic polypeptide
  PDL1-IFN-R01-C11
QVQLVQSGAEVKKPGASVKVSCKASGGTFSSYAISWVRQAPGQGLEWMGWMDANNGNTGYAQKFQGRVTMTRDTSTSTVYMELSSLRSEDTAVYYCARSLFPTIFGVEVAFDIWGQGTLVTVSSASGGGGSGGGGSGGGGSHASDIQMTQSPSSLSASVGDRVTITCRASQSVSSYLNWYQQKPGKAPKLLIYKASSLESGVPSRFSGSGSGTDFTLTISSLQPEDFATYYCQQSSSTPLSFGGGTKVEIK

SEQ ID NO: 28 - protein, 247 aa, Artificial Sequence
  Description of Artificial Sequence: Synthetic polypeptide
  anti-Her2 control (trastuzumab)
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASGGGGSGGGGSGGGGSHASDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIK

SEQ ID NO: 29 - protein, 246 aa, Artificial Sequence
  Description of Artificial Sequence: Synthetic polypeptide
  Anti-PD-L1 control (atezolizumab)
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSAASGGGGSGGGGSGGGGSHASDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 30 - protein, 248 aa, Artificial Sequence
  Description of Artificial Sequence: Synthetic polypeptide
  Anti-IFN control (rontalizumab)
EVQLVESGGGLVQPGGSLRLSCATSGYTFTEYIIHWVRQAPGKGLEWVASINPDYDITNYNQRFKGRFTISLDKSKRTAYLQMNSLRAEDTAVYYCASWISDFFDYWGQGTLVTVSSASGGGGSGGGGSGGGGSHASDIQMTQSPSSLSASVGDRVTITCRASQSVSTSSYSYMHWYQQKPGKAPKVLISYASNLESGVPSRFSGSGSGTDFTLTISSLQPEDFATYYCQHSWGIPRTFGQGTKVEIK

SEQ ID NO: 31 - protein, 251 aa, Artificial Sequence
  Description of Artificial Sequence: Synthetic polypeptide
  PD1-IL2-R02-C02
QVQLVQSGAEVKKPGVSVKVSCKASGYTFPRSYIHWVRQAPGQGLEWMGWINPHSGDTYYAQNFQGRVTMTRDTSTSTVYMELSSLRSEDTAVYYCARDTGLGYYYGSGDFDYWGQGTLVTVSSASGGGGSGGGGSGGGGSHASDIQMTQSPSSLSASVGDRVTITCRASQSISRYLNWYQQKPGKAPKLLIYTASSLQSGVPSRFSGSGSGTDFTLTISSLQPEDFATYYCQQANRFPLTFGPGTKVDIK

SEQ ID NO: 32 - protein, 251 aa, Artificial Sequence
  Description of Artificial Sequence: Synthetic polypeptide
  PD1-IL2-R02-C03
QVQLVQSGAEVKKPGASVKVSCKASGYTFPRYHIHWVRQAPGQGLEWMGMINPSGGTTTYAQKFQGRVTMTRDTSTSTVYMELSSLRSEDTAVYYCARDTGLGYYYGSGDFDYWGQGTLVTVSSASGGGGSGGGGSGGGGSHASDIQMTQSPSSLSASVGDRVTITCRASQSISSWLAWYQQKPGKAPKLLIYAASSLQSGVPSRFSGSGSGTDFTLTISSLQPEDFATYYCQQSHSFPLTFGGGTKVEIK

SEQ ID NO: 33 - protein, 245 aa, Artificial Sequence
  Description of Artificial Sequence: Synthetic polypeptide
  PD1-IL2-R06-E04
QVQLVQSGAEVKKPGASVKVSCKASGYTFTRYYIHWVRQAPGQGLEWMGWINAYNGDTNYAQKLQGRVTMTRDTSTSTVYMELSSLRSEDTAVYYCARDSYYYDSFDYWGQGTLVTVSSASGGGGSGGGGSGGGGSHASDIQMTQSPSSLSASVGDRVTITCRASQTITDWLAWYQQKPGKAPKLLIYGASNLQGGVPSRFSGSGSGTDFTLTISSLQPEDFATYYCQQYYSSWTFGQGTKVEIK

SEQ ID NO: 34 - protein, 246 aa, Artificial Sequence
  Description of Artificial Sequence: Synthetic polypeptide
  PD1-IL2-R07-A09
QVQLVQSGAEVKKPGASVKVSCKASGYTFTSYYMHWVRQAPGQGLEWMGIINPSDGSTTYAQSFQGRVTMTRDTSTSTVYMELSSLRSEDTAVYYCASGWDVWGQGTLVTVSSASGGGGSGGGGSGGGGSHASDIVMTQSPDSLAVSLGERATINCKSSQSVFSSANNKNYLAWYQQKPGQPPKLLIYWASTRESGVPDRFSGSGSGTDFTLTISSLQAEDVAVYYCQQYFGTPVTFGGGTKVEIK

SEQ ID NO: 35 - protein, 245 aa, Artificial Sequence
  Description of Artificial Sequence: Synthetic polypeptide
  H_N36G
QVQLVQSGAEVKKPGASVKVSCKASGYTFSGYYIHWVRQAPGQGLEWMGWMDSNSGGTGYAQKFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 36 - protein, 245 aa, Artificial Sequence
  Description of Artificial Sequence: Synthetic polypeptide
  H_I39V_S58P_Q69H_K70Q
QVQLVQSGAEVKKPGASVKVSCKASGYTFSNYYVHWVRQAPGQGLEWMGWMDPNSGGTGYAHQFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 37 - protein, 245 aa, Artificial Sequence
  Description of Artificial Sequence: Synthetic polypeptide
  H_G64Y_Q69H
QVQLVQSGAEVKKPGASVKVSCKASGYTFSNYYIHWVRQAPGQGLEWMGWMDSNSGYTGYAHKFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 38 - protein, 245 aa, Artificial Sequence
  Description of Artificial Sequence: Synthetic polypeptide
  L_Q68E
QVQLVQSGAEVKKPGASVKVSCKASGYTFSNYYIHWVRQAPGQGLEWMGWMDSNSGGTGYAQKFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLESGVPSRFSGSGSGTDFTLTISSLQPEDFATYYCQQSYSTPYTFGQGTKVEIK

SEQ ID NO: 39 - protein, 245 aa, Artificial Sequence
  Description of Artificial Sequence: Synthetic polypeptide
  L_Q68E_E125D
QVQLVQSGAEVKKPGASVKVSCKASGYTFSNYYIHWVRQAPGQGLEWMGWMDSNSGGTGYAQKFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLESGVPSRFSGSGSGTDFTLTISSLQPEDFATYYCQQSYSTPYTFGQGTKVDIK

SEQ ID NO: 40 - DNA, 924 bp, Artificial Sequence
  Description of Artificial Sequence: Synthetic polynucleotide
  scFv_PDL1-IFN_R01_C08_gBlock
gcgaattaatacgactcactatagggcttaagtataaggagaataatatatgtctacttcaacagaacaaaagttaattagtgaagaagatttacaggtccagttggttcagtcaggcgcagaagtcaaaaagccgggagcgagtgtcaaagtatcttgtaaagcgagcggtggtacttttagtagttatgcgatttcctgggttcgccaagccccgggacagggtctggaatggatgggtattattgacccttccgtgacttacacccgctacgctcagaaattccagggacgtgttaccatgacccgcgataccagcaccagtaccgtttacatggaactttcctccctgagatcggaagacacggccgtgtattattgcgctcgctcactctttccgaccatcttcggcgttgaagtcgccttcgacatctggggccagggcacgctggttacggtaagttccgcaagtggcggtggtggtagtggtggaggtggatcaggaggaggtggttctcacgcatcagacattcaaatgacacagagtccatcatccctttctgcctccgtgggtgaccgggtgacgataacctgccaagctagccaagacattagcaactatctgaactggtaccagcaaaagcctgggaaagctccgaaactattgatttacggtgcgtcgactctccagagtggggtacctagtcgtttttccggttcagggtcgggtacagattttacccttactatttcctctctgcagccagaagactttgctacttattactgccaacagacttattcgactccgattacgtttggccagggaaccaaagtcgaaatcaaaggcaagccgatcccgaaccctctgctgggattagacagcacgtaactagcataacccctctctaaacggaggggttt

SEQ ID NO: 41 - protein, 449 aa, Artificial Sequence
  Description of Artificial Sequence: Synthetic polypeptide
  AF2719 (H_I39V_S58P_Q69H_K70Q)
MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGYTFSNYYVHWVRQAPGQGLEWMGWMDPNSGGTGYAHQFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKGKPIPNPLLGLDST

SEQ ID NO: 42 - protein, 481 aa, Artificial Sequence
  Description of Artificial Sequence: Synthetic polypeptide
  PDL1-IFN_uIFN_2D10scFv_KiH_PDL1-IFN_1A05_H_N36G_Pep1
QVQLVQSGAEVKKPGASVKVSCKASGYTFTKNYMHWVRQAPGQGLEWLGWVSPDSGYTGYAQKFQGRVTMTRDTSTSTVYMELSSLRSEDTAVYYCTTDLLSLELDDAFDIWGQGTMVTVSSASGGGGSGGGGSGGGGSHASDIQMTQSPSSLSASVGDRVTITCRASQSISSWLAWYQQKPGKAPKLLIYAASTLQSGVPSRFSGSGSGTDFTLTISSLQPEDFATYYCQQSYSTPLTFGGGTKLEIKPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPCEEEMTKKQVTLSCAVTDFMPEDIYVEWTNNGKTELNYKNTEPVLDSDGSYFMVSKLRVEKKNWVERNSYSCSVVHEGLHNHHTTKSFSRTPGK

SEQ ID NO: 43 - protein, 633 aa, Artificial Sequence
  Description of Artificial Sequence: Synthetic polypeptide
  PDL1-IFN_uIFN_2D10scFv_KiH_PDL1-IFN_1A05_H_N36G_Pep2
CDLPQTHSLGSRRTLMLLAQMRRISLFSCLKDRHDFGFPQEEFGNQFQKAETIPVLHEMIQQIFNLFSTKDSSAAWDETLLDKFCTELYQQLNDLEACVMQEERVGETPLMNADSILAVKKYFRRITLYLTEKKYSPCAWEVVRAEIVRSLSLSTNLQERLRRKEGGGGSGGGGSGGGGSGGGGSQVQLVQSGAEVKKPGASVKVSCKASGYTFSGYYIHWVRQAPGQGLEWMGWMDSNSGGTGYAQKFQGRVTMTRDTSTSTVYMELSSLRSEDTAVYYCAKEVFSGWYDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVCVLPPPEEEMTKKQVTLWCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 44 - protein, 214 aa, Artificial Sequence
  Description of Artificial Sequence: Synthetic polypeptide
  PDL1-IFN_uIFN_2D10scFv_KiH_PDL1-IFN_1A05_H_N36G_Pep3
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 45 - protein, 454 aa, Artificial Sequence
  Description of Artificial Sequence: Synthetic polypeptide
  uIFN_IgG_KH_PDL1-IFN_R01_C08_28S_N40A_G56K_T66S_Q68E_Pep1
QVQLVQSGAEVKKPGASVKVSCKASGGTFSSYAISWVRQAPGQGLEWMGIIDPSVTYTRYAQKFQGRVTMTRDTSTSTVYMELSSLRSEDTAVYYCARSLFPTIFGVEVAFDIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPCEEEMTKKQVTLSCAVTDFMPEDIYVEWTNNGKTELNYKNTEPVLDSDGSYFMVSKLRVEKKNWVERNSYSCSVVHEGLHNHHTTKSFSRTPGK

SEQ ID NO: 46 - protein, 639 aa, Artificial Sequence
  Description of Artificial Sequence: Synthetic polypeptide
  uIFN_IgG_KH_PDL1-IFN_R01_C08_28S_N40A_G56K_T66S_Q68E_Pep2
CDLPQTHSLGSRRTLMLLAQMRRISLFSCLKDRHDFGFPQEEFGNQFQKAETIPVLHEMIQQIFNLFSTKDSSAAWDETLLDKFCTELYQQLNDLEACVMQEERVGETPLMNADSILAVKKYFRRITLYLTEKKYSPCAWEVVRAEIVRSLSLSTNLQERLRRKEGGGGSGGGGSGGGGSGGGGSQVQLVQSGAEVKKPGASVKVSCKASGGTFSSYAISWVRQAPGQGLEWMGIIDPSVTYTRYAQKFQGRVTMTRDTSTSTVYMELSSLRSEDTAVYYCARSLFPTIFGVEVAFDIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVCVLPPPEEEMTKKQVTLWCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 47 - protein, 214 aa, Artificial Sequence
  Description of Artificial Sequence: Synthetic polypeptide
  uIFN_IgG_KH_PDL1-IFN_R01_C08_28S_N40A_G56K_T66S_Q68E_Pep3
DIQMTQSPSSLSASVGDRVTITCQASQSISNYLAWYQQKPGKAPKLLIYKASSLESGVPSRFSGSGSGTDFTLTISSLQPEDFATYYCQQTYSTPITFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 48 - protein, 766 aa, Artificial Sequence
  Description of Artificial Sequence: Synthetic polypeptide
  ExemplarySeq_C_Pep1
CDLPQTHSLGSRRTLMLLAQMRRISLFSCLKDRHDFGFPQEEFGNQFQKAETIPVLHEMIQQIFNLFSTKDSSAAWDETLLDKFCTELYQQLNDLEACVMQEERVGETPLMNADSILAVKKYFRRITLYLTEKKYSPCAWEVVRAEIVRSLSLSTNLQERLRRKEGGGGSGGGGSGGGGSGGGGSQVQLVQSGAEVKKPGASVKVSCKASGGTFSSYAISWVRQAPGQGLEWMGIIDPSVTYTRYAQKFQGRVTMTRDTSTSTVYMELSSLRSEDTAVYYCARSLFPTIFGVEVAFDIWGQGTLVTVSSASGGGGSGGGGSGGGGSHASDIQMTQSPSSLSASVGDRVTITCQASQDISNYLNWYQQKPGKAPKLLIYGASTLQSGVPSRFSGSGSGTDFTLTISSLQPEDFATYYCQQTYSTPITFGQGTKVEIKAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPCEEEMTKKQVTLSCAVTDFMPEDIYVEWTNNGKTELNYKNTEPVLDSDGSYFMVSKLRVEKKNWVERNSYSCSVVHEGLHNHHTTKSFSRTPGK

SEQ ID NO: 49 - protein, 448 aa, Artificial Sequence
  Description of Artificial Sequence: Synthetic polypeptide
  ExemplarySeq_C_Pep2
QVQLVQSGAEVKKPGASVKVSCKASGYTFSGYYIHWVRQAPGQGLEWMGWMDSNSGGTGYAQKFQGRVTMTRDTSTSTVYMELSSLRSEDTAVYYCAKEVFSGWYDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVCVLPPPEEEMTKKQVTLWCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 50 - protein, 214 aa, Artificial Sequence; identical to SEQ ID NO: 44
  Description of Artificial Sequence: Synthetic polypeptide
  ExemplarySeq_C_Pep3

SEQ ID NO: 51 - protein, 443 aa, Artificial Sequence
  Description of Artificial Sequence: Synthetic polypeptide
  PD1-IL2_6C12_N36T_Sym_L_Long_Pep1
QVQLVQSGAEVKKPGASVKVSCKASGYTFSTYYIHWVRQAPGQGLEWMGIINPSGGGTVYAQKFQGRVTMTRDTSTSTVYMELSSLRSEDTAVYYCAAGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 52 - protein, 407 aa, Artificial Sequence
  Description of Artificial Sequence: Synthetic polypeptide
  PD1-IL2_6C12_N36T_Sym_L_Long_Pep2
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTVPGVGVPGAGVPGVGVPGGGVPGVGVPGGGVPGAGVPGGGVPGVGVPGAGVPGVGVPGGGDIQMTQSPSSLSASVGDRVTITCRASQYISSGLAWYQQKPGKAPKLLIYKASSLDNGVPSRFSGSGSGTDFTLTISSLQPEDFATYYCQQYERLPLTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 53 - protein, 596 aa, Artificial Sequence
  Description of Artificial Sequence: Synthetic polypeptide
  PD1-IL2_6C12_N36T_D68E_Sym_H_Short_Pep1
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSGGGGSQVQLVQSGAEVKKPGASVKVSCKASGYTFSTYYIHWVRQAPGQGLEWMGIINPSGGGTVYAQKFQGRVTMTRDTSTSTVYMELSSLRSEDTAVYYCAAGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 54 - protein, 214 aa, Artificial Sequence
  Description of Artificial Sequence: Synthetic polypeptide
  PD1-IL2_6C12_N36T_D68E_Sym_H_Short_Pep2
DIQMTQSPSSLSASVGDRVTITCRASQYISSGLAWYQQKPGKAPKLLIYKASSLENGVPSRFSGSGSGTDFTLTISSLQPEDFATYYCQQYERLPLTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 55 - protein, 455 aa, Artificial Sequence
  Description of Artificial Sequence: Synthetic polypeptide
  AF002718
MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGNTFTDYYMHWVRQAPGQGLEWMGWMNPNSGNTGYAQKFQGRVTMTRDTSTSTVYMELSSLRSEDTAVYYCARSLFPTIFGVEVAFDIWGQGTLVTVSSASGGGGSGGGGSGGGGSHASDIQMTQSPSSLSASVGDRVTITCQASQDISNYLNWYQQKPGKAPKLLIYAASSLESGVPSRFSGSGSGTDFTLTISSLQPEDFATYYCQQSYSTPPTFGQGTRLEIKGKPIPNPLLGLDST

SEQ ID NO: 56 - protein, 451 aa, Artificial Sequence
  Description of Artificial Sequence: Synthetic polypeptide
  anti-Her2-IFNa
MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASGGGGSGGGGSGGGGSHASDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGKPIPNPLLGLDST

SEQ ID NO: 57 - protein, 639 aa, Artificial Sequence
  Description of Artificial Sequence: Synthetic polypeptide
  C08 IFNa  heavy chain
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGGTFSSYAISWVRQAPGQGLEWMGIIDPSVTYTRYAQKFQGRVTMTRDTSTSTVYMELSSLRSEDTAVYYCARSLFPTIFGVEVAFDIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 58 - protein, 214 aa, Artificial Sequence
  Description of Artificial Sequence: Synthetic polypeptide
  C08 IFNa light chain
DIQMTQSPSSLSASVGDRVTITCQASQDISNYLNWYQQKPGKAPKLLIYGASTLQSGVPSRFSGSGSGTDFTLTISSLQPEDFATYYCQQTYSTPITFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 59 - protein, 639 aa, Artificial Sequence
  Description of Artificial Sequence: Synthetic polypeptide
  B09 IFNa heavy chain
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGGTFTGYYMHWVRQAPGQGLEWMGWVNPNSGNTGYAQKFQGRVTMTRDTSTSTVYMELSSLRSEDTAVYYCARSLFPTIFGVEVAFDIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 60 - protein, 214 aa, Artificial Sequence
  Description of Artificial Sequence: Synthetic polypeptide
  B09 IFNa light chain
DIQMTQSPSSLSASVGDRVTITCQASQDISNYLNWYQQKPGKAPKLLIYAASSLQSGVPSRFSGSGSGTDFTLTISSLQPEDFATYYCQQSYSPPPTFGQGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 61 - protein, 639 aa, Artificial Sequence
  Description of Artificial Sequence: Synthetic polypeptide
  anti-PD-L1-IFNa heavy chain
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGGTFSSYAISWVRQAPGQGLEWMGWINPNSGGTNYAQKFQGRVTMTRDTSTSTVYMELSSLRSEDTAVYYCARSLFPTIFGVEVAFDIWGQGTTVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 62 - protein, 214 aa, Artificial Sequence
  Description of Artificial Sequence: Synthetic polypeptide
  anti-PD-L1-IFNa light chain
DIQMTQSPSSLSASVGDRVTITCRASQSIIDRLAWYQQKPGKAPKLLIYKASSLESGVPSRFSGSGSGTDFTLTISSLQPEDFATYYCQQSYSTPFTFGPGTKVDIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 63 - protein, 635 aa, Artificial Sequence
  Description of Artificial Sequence: Synthetic polypeptide
  anti-HER2-IFNa heavy chain
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 64 - protein, 214 aa, Artificial Sequence
  Description of Artificial Sequence: Synthetic polypeptide
  anti-HER2-IFNa light chain
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 65 - protein, 450 aa, Artificial Sequence
  Description of Artificial Sequence: Synthetic polypeptide
  Anti-HER2 heavy chain
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 66 - protein, 407 aa, Artificial Sequence
  Description of Artificial Sequence: Synthetic polypeptide
  Anti-HER2 light chain
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTVPGVGVPGAGVPGVGVPGGGVPGVGVPGGGVPGAGVPGGGVPGVGVPGAGVPGVGVPGGGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 67 - protein, 454 aa, Artificial Sequence
  Description of Artificial Sequence: Synthetic polypeptide
  2_A08 heavy chain
QVQLVQSGAEVKKPGASVKVSCKVSGYTFTSYDINWVRQAPGQGLEWMGWINPNSGDTGYAQKFQGRVTMTRDTSTSTVYMELSSLRSEDTAVYYCARDTGLGYYYGSGDFDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 68 - protein, 407 aa, Artificial Sequence
  Description of Artificial Sequence: Synthetic polypeptide
  2_A08 light chain
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTVPGVGVPGAGVPGVGVPGGGVPGVGVPGGGVPGAGVPGGGVPGVGVPGAGVPGVGVPGGGDIQMTQSPSSLSASVGDRVTITCQASQDIHNYLNWYQQKPGKAPKLLIYDVSNLETGVPSRFSGSGSGTDFTLTISSLQPEDFATYYCQQAISFPLTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 69 - protein, 443 aa, Artificial Sequence
  Description of Artificial Sequence: Synthetic polypeptide
  2_A11 heavy chain
QVQLVQSGAEVKKPGASVKVSCKASGHTFTRYYMHWVRQAPGQGLEWMGIINPSGGYATYAQKFQGRVTMTRDTSTSTVYMELSSLRSEDTAVYYCASGWDVWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 70 - protein, 407 aa, Artificial Sequence
  Description of Artificial Sequence: Synthetic polypeptide
  2_A11 light chain
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTVPGVGVPGAGVPGVGVPGGGVPGVGVPGGGVPGAGVPGGGVPGVGVPGAGVPGVGVPGGGDIQMTQSPSSLSASVGDRVTITCRASQSINSWLAWYQQKPGKAPKLLIYATSTLESGVPSRFSGSGSGTDFTLTISSLQPEDFATYYCQQSYSFPPTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 71 - protein, 443 aa, Artificial Sequence
  Description of Artificial Sequence: Synthetic polypeptide
  2_B05 heavy chain
QVQLVQSGAEVKKPGASVKVSCKASGYTFTNYYIHWVRQAPGQGLEWMGIINPRAGYTSYALKFQGRVTMTRDTSTSTVYMELSSLRSEDTAVYYCAGGWLDWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 72 - protein, 407 aa, Artificial Sequence
  Description of Artificial Sequence: Synthetic polypeptide
  2_B05 light chain
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTVPGVGVPGAGVPGVGVPGGGVPGVGVPGGGVPGAGVPGGGVPGVGVPGAGVPGVGVPGGGDIQMTQSPSSLSASVGDRVTITCRASQSISSWLAWYQQKPGKAPKLLIYAASSLQSGVPSRFSGSGSGTDFTLTISSLQPEDFATYYCQQSFTMPITFGQGTRLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 73 - protein, 443 aa, Artificial Sequence
  Description of Artificial Sequence: Synthetic polypeptide
  2_B07 heavy chain
QVQLVQSGAEVKKPGASVKVSCKASGDTFTRHYVHWVRQAPGQGLEWMGIINPSGGYASYAQKFQGRVTMTRDTSTSTVYMELSSLRSEDTAVYYCAAGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 74 - protein, 407 aa, Artificial Sequence
  Description of Artificial Sequence: Synthetic polypeptide
  2_B07 light chain
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTVPGVGVPGAGVPGVGVPGGGVPGVGVPGGGVPGAGVPGGGVPGVGVPGAGVPGVGVPGGGDIQMTQSPSSLSASVGDRVTITCRASQSIGRWLAWYQQKPGKAPKLLIYSASNLETGVPSRFSGSGSGTDFTLTISSLQPEDFATYYCQQANSFPVTFGPGTKVDIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 75 - protein, 443 aa, Artificial Sequence
  Description of Artificial Sequence: Synthetic polypeptide
  7_A04 heavy chain
QVQLVQSGAEVKKPGASVKVSCKASGYTFTDYYMHWVRQAPGQGLEWMGIINPRAGYTSYALKFQGRVTMTRDTSTSTVYMELSSLRSEDTAVYYCTSGMDVWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 76 - protein, 407 aa, Artificial Sequence
  Description of Artificial Sequence: Synthetic polypeptide
  7_A04 light chain
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTVPGVGVPGAGVPGVGVPGGGVPGVGVPGGGVPGAGVPGGGVPGVGVPGAGVPGVGVPGGGDIQMTQSPSSLSASVGDRVTITCRASQSISTWLAWYQQKPGKAPKLLIYAASSLQSGVPSRFSGSGSGTDFTLTISSLQPEDFATYYCQQSYSFPVTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 77 - protein, 443 aa, Artificial Sequence
  Description of Artificial Sequence: Synthetic polypeptide
  PD1-IL2_L_7A05scFv_PD1-R07-A05_Pep1
QVQLVQSGAEVKKPGASVKVSCKASGYTFTTYYVHWVRQAPGQGLEWMGIINPSGGSTSYAQNFQGRVTMTRDTSTSTVYMELSSLRSEDTAVYYCASGWDVWGQGTTVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 78 - protein, 485 aa, Artificial Sequence
  Description of Artificial Sequence: Synthetic polypeptide
  PD1-IL2_L_7A05scFv_PD1-R07-A05_Pep2
QVQLVQSGAEVKKPGASVKVSCKASGYTFTTYYVHWVRQAPGQGLEWMGIINPSGGSTSYAQNFQGRVTMTRDTSTSTVYMELSSLRSEDTAVYYCASGWDVWGQGTTVTVSSASGGGGSGGGGSGGGGSHASEIVMTQSPATLSVSPGERATLSCRASQSVNTYLAWYQQKPGQAPRLLIYGASTRATGIPARFSGSGSGTEFTLTISSLQSEDFAVYYCQQYGSSPVTFGQGTRLEIKPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGSGGGSHHHHHH

SEQ ID NO: 79 - protein, 367 aa, Artificial Sequence
  Description of Artificial Sequence: Synthetic polypeptide
  PD1-IL2_L_7A05scFv_PD1-R07-A05_Pep3
APTSSSTKKTQLQLEHLLLDLQMILNGINNYKNPKLTDMLTFKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSGGGGSEIVMTQSPATLSVSPGERATLSCRASQSVNTYLAWYQQKPGQAPRLLIYGASTRATGIPARFSGSGSGTEFTLTISSLQSEDFAVYYCQQYGSSPVTFGQGTRLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 80 - protein, 596 aa, Artificial Sequence
  Description of Artificial Sequence: Synthetic polypeptide
  AF003229_Pep1
APTSSSTKKTQLQLEHLLLDLQMILNGINNYKNPKLTDMLTFKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSGGGGSQVQLVQSGAEVKKPGASVKVSCKASGDTFSTYYVHWVRQAPGQGLEWMGIINPSGGGTVYAQKFQGRVTMTRDTSTSTVYMELSSLRSEDTAVYYCAAGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 81 - protein, 596 aa, Artificial Sequence
  Description of Artificial Sequence: Synthetic polypeptide
  AF003230_Pep1
APTSSSTKKTQLQLEHLLLDLQMILNGINNYKNPKLTDMLTFKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSGGGGSQVQLVQSGAEVKKPGASVKVSCKASGYTFSNYYIHWVRQAPGQGLEWMGIINPSGGGTVYAQKFQGRVTMTRDTSTSTVYMELSSLRSEDTAVYYCAAGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 82 - protein, 596 aa, Artificial Sequence
  Description of Artificial Sequence: Synthetic polypeptide
  AF003232_Pep1
APTSSSTKKTQLQLEHLLLDLQMILNGINNYKNPKLTDMLTFKFYMPKKATELKHLQCLEEELKPLEEVLNLAQSKNFHLRPRDLISNINVIVLELKGSETTFMCEYADETATIVEFLNRWITFCQSIISTLTGGGGSGGGGSGGGGSGGGGSQVQLVQSGAEVKKPGASVKVSCKASGDTFTRHYVHWVRQAPGQGLEWMGIINPSGGYASYAQKFQGRVTMTRDTSTSTVYMELSSLRSEDTAVYYCAAGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 83 - protein, 596 aa, Artificial Sequence; identical to SEQ ID NO: 80
  Description of Artificial Sequence: Synthetic polypeptide
  AF003250_Pep1

SEQ ID NO: 84 - protein, 596 aa, Artificial Sequence; identical to SEQ ID NO: 81
  Description of Artificial Sequence: Synthetic polypeptide
  AF003251_Pep1

SEQ ID NO: 85 - protein, 596 aa, Artificial Sequence; identical to SEQ ID NO: 82
  Description of Artificial Sequence: Synthetic polypeptide
  AF003253_Pep1

SEQ ID NO: 86 - protein, 639 aa, Artificial Sequence; identical to SEQ ID NO: 46
  Description of Artificial Sequence: Synthetic polypeptide
  AF003103_Pep1

SEQ ID NO: 87 - protein, 633 aa, Artificial Sequence
  Description of Artificial Sequence: Synthetic polypeptide
  AF003104_Pep1
CDLPQTHSLGSRRTLMLLAQMRRISLFSCLKDRHDFGFPQEEFGNQFQKAETIPVLHEMIQQIFNLFSTKDSSAAWDETLLDKFCTELYQQLNDLEACVMQEERVGETPLMNADSILAVKKYFRRITLYLTEKKYSPCAWEVVRAEIVRSLSLSTNLQERLRRKEGGGGSGGGGSGGGGSGGGGSQVQLVQSGAEVKKPGASVKVSCKASGYTFSNYYIHWVRQAPGQGLEWMGWMDSNSGGTGYAQKFQGRVTMTRDTSTSTVYMELSSLRSEDTAVYYCAKEVFSGWYDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVCVLPPPEEEMTKKQVTLWCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 88 - protein, 633 aa, Artificial Sequence; identical to SEQ ID NO: 43
  Description of Artificial Sequence: Synthetic polypeptide
  AF003105_Pep1

SEQ ID NO: 89 - protein, 633 aa, Artificial Sequence
  Description of Artificial Sequence: Synthetic polypeptide
  AF003106_Pep1
CDLPQTHSLGSRRTLMLLAQMRRISLFSCLKDRHDFGFPQEEFGNQFQKAETIPVLHEMIQQIFNLFSTKDSSAAWDETLLDKFCTELYQQLNDLEACVMQEERVGETPLMNADSILAVKKYFRRITLYLTEKKYSPCAWEVVRAEIVRSLSLSTNLQERLRRKEGGGGSGGGGSGGGGSGGGGSQVQLVQSGAEVKKPGASVKVSCKASGYTFSNYYIHWVRQAPGQGLEWMGWMDSNSGYTGYAQQFQGRVTMTRDTSTSTVYMELSSLRSEDTAVYYCAKEVFSGWYDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVCVLPPPEEEMTKKQVTLWCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 90 - protein, 639 aa, Artificial Sequence; identical to SEQ ID NO: 46
  Description of Artificial Sequence: Synthetic polypeptide
  AF003217_Pep1

SEQ ID NO: 91 - protein, 633 aa, Artificial Sequence; identical to SEQ ID NO: 43
  Description of Artificial Sequence: Synthetic polypeptide
  AF003218_Pep1

SEQ ID NO: 92 - protein, 633 aa, Artificial Sequence; identical to SEQ ID NO: 87
  Description of Artificial Sequence: Synthetic polypeptide
  AF003219_Pep1

SEQ ID NO: 93 - protein, 454 aa, Artificial Sequence
  Description of Artificial Sequence: Synthetic polypeptide
  AF002618_Pep1
QVQLVQSGAEVKKPGASVKVSCKASGGTFSSYAISWVRQAPGQGLEWMGIIDPSVTYTRYAQKFQGRVTMTRDTSTSTVYMELSSLRSEDTAVYYCARSLFPTIFGVEVAFDIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 94 - protein, 448 aa, Artificial Sequence
  Description of Artificial Sequence: Synthetic polypeptide
  AF002639_Pep1
QVQLVQSGAEVKKPGASVKVSCKASGYTFSNYYIHWVRQAPGQGLEWMGWMDSNSGYTGYAQQFQGRVTMTRDTSTSTVYMELSSLRSEDTAVYYCAKEVFSGWYDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 95 - protein, 679 aa, Artificial Sequence
  Description of Artificial Sequence: Synthetic polypeptide
  AF002645_Pep1
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEVPGVGVPGAGVPGVGVPGGGVPGVGVPGGGVPGAGVPGGGVPGVGVPGAGVPGVGVPGGGQVQLVQSGAEVKKPGASVKVSCKASGGTFSSYAISWVRQAPGQGLEWMGIIDPSVTYTRYAQKFQGRVTMTRDTSTSTVYMELSSLRSEDTAVYYCARSLFPTIFGVEVAFDIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 96 - protein, 673 aa, Artificial Sequence
  Description of Artificial Sequence: Synthetic polypeptide
  AF002666_Pep1
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEVPGVGVPGAGVPGVGVPGGGVPGVGVPGGGVPGAGVPGGGVPGVGVPGAGVPGVGVPGGGQVQLVQSGAEVKKPGASVKVSCKASGYTFSNYYIHWVRQAPGQGLEWMGWMDSNSGYTGYAQQFQGRVTMTRDTSTSTVYMELSSLRSEDTAVYYCAKEVFSGWYDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 97 - protein, 456 aa, Artificial Sequence
  Description of Artificial Sequence: Synthetic polypeptide
  AF003229_Pep2
QVQLVQSGAEVKKPGASVKVSCKASGDTFSTYYVHWVRQAPGQGLEWMGIINPSGGGTVYAQKFQGRVTMTRDTSTSTVYMELSSLRSEDTAVYYCAAGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGSGGGSHHHHHH

SEQ ID NO: 98 - protein, 456 aa, Artificial Sequence
  Description of Artificial Sequence: Synthetic polypeptide
  AF003230_Pep2
QVQLVQSGAEVKKPGASVKVSCKASGYTFSNYYIHWVRQAPGQGLEWMGIINPSGGGTVYAQKFQGRVTMTRDTSTSTVYMELSSLRSEDTAVYYCAAGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGSGGGSHHHHHH

SEQ ID NO: 99 - protein, 456 aa, Artificial Sequence
  Description of Artificial Sequence: Synthetic polypeptide
  AF003232_Pep2
QVQLVQSGAEVKKPGASVKVSCKASGDTFTRHYVHWVRQAPGQGLEWMGIINPSGGYASYAQKFQGRVTMTRDTSTSTVYMELSSLRSEDTAVYYCAAGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGSGGGSHHHHHH

SEQ ID NO: 100 - protein, 485 aa, Artificial Sequence; identical to SEQ ID NO: 78
  Description of Artificial Sequence: Synthetic polypeptide
  AF003250_Pep2

SEQ ID NO: 101 - protein, 485 aa, Artificial Sequence; identical to SEQ ID NO: 78
  Description of Artificial Sequence: Synthetic polypeptide
  AF003251_Pep2

SEQ ID NO: 102 - protein, 485 aa, Artificial Sequence; identical to SEQ ID NO: 78
  Description of Artificial Sequence: Synthetic polypeptide
  AF003253_Pep2

SEQ ID NO: 103 - protein, 460 aa, Artificial Sequence
  Description of Artificial Sequence: Synthetic polypeptide
  AF003103_Pep2
QVQLVQSGAEVKKPGASVKVSCKASGGTFSSYAISWVRQAPGQGLEWMGIIDPSVTYTRYAQKFQGRVTMTRDTSTSTVYMELSSLRSEDTAVYYCARSLFPTIFGVEVAFDIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPCEEEMTKKQVTLSCAVTDFMPEDIYVEWTNNGKTELNYKNTEPVLDSDGSYFMVSKLRVEKKNWVERNSYSCSVVHEGLHNHHTTKSFSRTPGKHHHHHH

SEQ ID NO: 104 - protein, 454 aa, Artificial Sequence
  Description of Artificial Sequence: Synthetic polypeptide
  AF003104_Pep2
QVQLVQSGAEVKKPGASVKVSCKASGYTFSNYYIHWVRQAPGQGLEWMGWMDSNSGGTGYAQKFQGRVTMTRDTSTSTVYMELSSLRSEDTAVYYCAKEVFSGWYDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPCEEEMTKKQVTLSCAVTDFMPEDIYVEWTNNGKTELNYKNTEPVLDSDGSYFMVSKLRVEKKNWVERNSYSCSVVHEGLHNHHTTKSFSRTPGKHHHHHH

SEQ ID NO: 105 - protein, 454 aa, Artificial Sequence
  Description of Artificial Sequence: Synthetic polypeptide
  AF003105_Pep2
QVQLVQSGAEVKKPGASVKVSCKASGYTFSGYYIHWVRQAPGQGLEWMGWMDSNSGGTGYAQKFQGRVTMTRDTSTSTVYMELSSLRSEDTAVYYCAKEVFSGWYDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPCEEEMTKKQVTLSCAVTDFMPEDIYVEWTNNGKTELNYKNTEPVLDSDGSYFMVSKLRVEKKNWVERNSYSCSVVHEGLHNHHTTKSFSRTPGKHHHHHH

SEQ ID NO: 106 - protein, 454 aa, Artificial Sequence
  Description of Artificial Sequence: Synthetic polypeptide
  AF003106_Pep2
QVQLVQSGAEVKKPGASVKVSCKASGYTFSNYYIHWVRQAPGQGLEWMGWMDSNSGYTGYAQQFQGRVTMTRDTSTSTVYMELSSLRSEDTAVYYCAKEVFSGWYDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPCEEEMTKKQVTLSCAVTDFMPEDIYVEWTNNGKTELNYKNTEPVLDSDGSYFMVSKLRVEKKNWVERNSYSCSVVHEGLHNHHTTKSFSRTPGKHHHHHH

SEQ ID NO: 107 - protein, 481 aa, Artificial Sequence; identical to SEQ ID NO: 42
  Description of Artificial Sequence: Synthetic polypeptide
  AF003217_Pep2

SEQ ID NO: 108 - protein, 481 aa, Artificial Sequence; identical to SEQ ID NO: 42
  Description of Artificial Sequence: Synthetic polypeptide
  AF003218_Pep2

SEQ ID NO: 109 - protein, 481 aa, Artificial Sequence; identical to SEQ ID NO: 42
  Description of Artificial Sequence: Synthetic polypeptide
  AF003219_Pep2

SEQ ID NO: 110 - protein, 399 aa, Artificial Sequence
  Description of Artificial Sequence: Synthetic polypeptide
  AF002618_Pep2
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSDIQMTQSPSSLSASVGDRVTITCRASQSISNRLAWYQQKPGKAPKLLIYKASSLESGVPSRFSGSGSGTDFTLTISSLQPEDFATYYCQQSNSTPFTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 111 - protein, 399 aa, Artificial Sequence
  Description of Artificial Sequence: Synthetic polypeptide
  AF002639_Pep2
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 112 - protein, 214 aa, Artificial Sequence
  Description of Artificial Sequence: Synthetic polypeptide
  AF002645_Pep2
DIQMTQSPSSLSASVGDRVTITCRASQSISNRLAWYQQKPGKAPKLLIYKASSLESGVPSRFSGSGSGTDFTLTISSLQPEDFATYYCQQSNSTPFTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 113 - skipped

SEQ ID NO: 114 - protein, 214 aa, Artificial Sequence
  Description of Artificial Sequence: Synthetic polypeptide
  AF003229_Pep3
DIQMTQSPSSLSASVGDRVTITCRASQYISSGLAWYQQKPGKAPKLLIYKASSLDNGVPSRFSGSGSGTDFTLTISSLQPEDFATYYCQQYERLPLTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 115 - protein, 214 aa, Artificial Sequence
  Description of Artificial Sequence: Synthetic polypeptide
  AF003230_Pep3
DIQMTQSPSSLSASVGDRVTITCRASQSIGTGLAWYQQKPGKAPKLLIYKASSLDNGVPSRFSGSGSGTDFTLTISSLQPEDFATYYCQQYNRAPLTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 116 - protein, 214 aa, Artificial Sequence
  Description of Artificial Sequence: Synthetic polypeptide
  AF003232_Pep3
DIQMTQSPSSLSASVGDRVTITCRASQSIGRWLAWYQQKPGKAPKLLIYSASNLETGVPSRFSGSGSGTDFTLTISSLQPEDFATYYCQQYESFPVTFGPGTKVDIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 117-125 - skipped (9 entries)

SEQ ID NO: 126 - protein, 214 aa, Artificial Sequence
  Description of Artificial Sequence: Synthetic polypeptide
  AF003219_Pep3
DIQMTQSPSSLSASVGDRVTITCRASQSISSYLNWYQQKPGKAPKLLIYAASSLESGVPSRFSGSGSGTDFTLTISSLQPEDFATYYCQQSYSTPYTFGQGTKVDIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 127 - protein, 113 aa, Artificial Sequence
  Description of Artificial Sequence: Synthetic polypeptide
  AB001718_HV
QVQLVQSGAEVKKPGASVKVSCKASGDTFSTYYVHWVRQAPGQGLEWMGIINPSGGGTVYAQKFQGRVTMTRDTSTSTVYMELSSLRSEDTAVYYCAAGLFIWGQGTLVTVSS

SEQ ID NO: 128 - protein, 113 aa, Artificial Sequence
  Description of Artificial Sequence: Synthetic polypeptide
  AB001744_HV
QVQLVQSGAEVKKPGASVKVSCKASGYTFSNYYIHWVRQAPGQGLEWMGIINPSGGGTVYAQKFQGRVTMTRDTSTSTVYMELSSLRSEDTAVYYCAAGLFIWGQGTLVTVSS

SEQ ID NO: 129 - protein, 113 aa, Artificial Sequence
  Description of Artificial Sequence: Synthetic polypeptide
  AB002022_HV
QVQLVQSGAEVKKPGASVKVSCKASGDTFTRHYVHWVRQAPGQGLEWMGIINPSGGYASYAQKFQGRVTMTRDTSTSTVYMELSSLRSEDTAVYYCAAGLFIWGQGTLVTVSS

SEQ ID NO: 130 - protein, 124 aa, Artificial Sequence
  Description of Artificial Sequence: Synthetic polypeptide
  AB001609_HV
QVQLVQSGAEVKKPGASVKVSCKASGGTFSSYAISWVRQAPGQGLEWMGIIDPSVTYTRYAQKFQGRVTMTRDTSTSTVYMELSSLRSEDTAVYYCARSLFPTIFGVEVAFDIWGQGTLVTVSS

SEQ ID NO: 131 - protein, 118 aa, Artificial Sequence
  Description of Artificial Sequence: Synthetic polypeptide
  AB001843_HV
QVQLVQSGAEVKKPGASVKVSCKASGYTFSGYYIHWVRQAPGQGLEWMGWMDSNSGGTGYAQKFQGRVTMTRDTSTSTVYMELSSLRSEDTAVYYCAKEVFSGWYDYWGQGTLVTVSS

SEQ ID NO: 132 - protein, 118 aa, Artificial Sequence
  Description of Artificial Sequence: Synthetic polypeptide
  AB001866_HV
QVQLVQSGAEVKKPGASVKVSCKASGYTFSNYYVHWVRQAPGQGLEWMGWMDPNSGGTGYAHQFQGRVTMTRDTSTSTVYMELSSLRSEDTAVYYCAKEVFSGWYDYWGQGTLVTVSS

SEQ ID NO: 133 - protein, 118 aa, Artificial Sequence
  Description of Artificial Sequence: Synthetic polypeptide
  AB001875_HV
QVQLVQSGAEVKKPGASVKVSCKASGYTFSNYYIHWVRQAPGQGLEWMGWMDSNSGYTGYAQQFQGRVTMTRDTSTSTVYMELSSLRSEDTAVYYCAKEVFSGWYDYWGQGTLVTVSS

SEQ ID NO: 134 - protein, 118 aa, Artificial Sequence
  Description of Artificial Sequence: Synthetic polypeptide
  AB001909_HV
QVQLVQSGAEVKKPGASVKVSCKASGYTFSNYYIHWVRQAPGQGLEWMGWMDSNSGGTGYAQKFQGRVTMTRDTSTSTVYMELSSLRSEDTAVYYCAKEVFSGWYDYWGQGTLVTVSS

SEQ ID NO: 135 - protein, 107 aa, Artificial Sequence
  Description of Artificial Sequence: Synthetic polypeptide
  AB001718_LV
DIQMTQSPSSLSASVGDRVTITCRASQYISSGLAWYQQKPGKAPKLLIYKASSLDNGVPSRFSGSGSGTDFTLTISSLQPEDFATYYCQQYERLPLTFGGGTKVEIK

SEQ ID NO: 136 - protein, 107 aa, Artificial Sequence
  Description of Artificial Sequence: Synthetic polypeptide
  AB001744_LV
DIQMTQSPSSLSASVGDRVTITCRASQSIGTGLAWYQQKPGKAPKLLIYKASSLDNGVPSRFSGSGSGTDFTLTISSLQPEDFATYYCQQYNRAPLTFGGGTKVEIK

SEQ ID NO: 137 - protein, 107 aa, Artificial Sequence
  Description of Artificial Sequence: Synthetic polypeptide
  AB002022_LV
DIQMTQSPSSLSASVGDRVTITCRASQSIGRWLAWYQQKPGKAPKLLIYSASNLETGVPSRFSGSGSGTDFTLTISSLQPEDFATYYCQQYESFPVTFGPGTKVDIK

SEQ ID NO: 138 - protein, 107 aa, Artificial Sequence
  Description of Artificial Sequence: Synthetic polypeptide
  AB001609_LV
DIQMTQSPSSLSASVGDRVTITCRASQSISNRLAWYQQKPGKAPKLLIYKASSLESGVPSRFSGSGSGTDFTLTISSLQPEDFATYYCQQSNSTPFTFGQGTKVEIK

SEQ ID NO: 139 - protein, 107 aa, Artificial Sequence
  Description of Artificial Sequence: Synthetic polypeptide
  AB001638_LV
DIQMTQSPSSLSASVGDRVTITCQASQSISNYLAWYQQKPGKAPKLLIYKASSLESGVPSRFSGSGSGTDFTLTISSLQPEDFATYYCQQTYSTPITFGQGTKVEIK

SEQ ID NO: 140 - protein, 107 aa, Artificial Sequence
  Description of Artificial Sequence: Synthetic polypeptide
  AB001843_LV
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 141 - protein, 107 aa, Artificial Sequence
  Description of Artificial Sequence: Synthetic polypeptide
  AB001909_LV
DIQMTQSPSSLSASVGDRVTITCRASQSISSYLNWYQQKPGKAPKLLIYAASSLESGVPSRFSGSGSGTDFTLTISSLQPEDFATYYCQQSYSTPYTFGQGTKVDIK

SEQ ID NO: 142 - protein, 10 aa, Artificial Sequence
  Description of Artificial Sequence: Synthetic peptide
  AB001718_HV_cdr1
GDTFSTYYVH

SEQ ID NO: 143 - protein, 10 aa, Artificial Sequence
  Description of Artificial Sequence: Synthetic peptide
  AB001744_HV_cdr1
GYTFSNYYIH

SEQ ID NO: 144 - protein, 10 aa, Artificial Sequence
  Description of Artificial Sequence: Synthetic peptide
  AB002022_HV_cdr1
GDTFTRHYVH

SEQ ID NO: 145 - protein, 10 aa, Artificial Sequence
  Description of Artificial Sequence: Synthetic peptide
  AB001609_HV_cdr1
GGTFSSYAIS

SEQ ID NO: 146 - protein, 10 aa, Artificial Sequence
  Description of Artificial Sequence: Synthetic peptide
  AB001843_HV_cdr1
GYTFSGYYIH

SEQ ID NO: 147 - protein, 10 aa, Artificial Sequence
  Description of Artificial Sequence: Synthetic peptide
  AB001866_HV_cdr1
GYTFSNYYVH

SEQ ID NO: 148 - protein, 17 aa, Artificial Sequence
  Description of Artificial Sequence: Synthetic peptide
  AB001718_HV_cdr2
IINPSGGGTVYAQKFQG

SEQ ID NO: 149 - protein, 17 aa, Artificial Sequence
  Description of Artificial Sequence: Synthetic peptide
  AB002022_HV_cdr2
IINPSGGYASYAQKFQG

SEQ ID NO: 150 - protein, 17 aa, Artificial Sequence
  Description of Artificial Sequence: Synthetic peptide
  AB001609_HV_cdr2
IIDPSVTYTRYAQKFQG

SEQ ID NO: 151 - protein, 17 aa, Artificial Sequence
  Description of Artificial Sequence: Synthetic peptide
  AB001843_HV_cdr2
WMDSNSGGTGYAQKFQG

SEQ ID NO: 152 - protein, 17 aa, Artificial Sequence
  Description of Artificial Sequence: Synthetic peptide
  AB001866_HV_cdr2
WMDPNSGGTGYAHQFQG

SEQ ID NO: 153 - protein, 17 aa, Artificial Sequence
  Description of Artificial Sequence: Synthetic peptide
  AB001875_HV_cdr2
WMDSNSGYTGYAQQFQG

SEQ ID NO: 154 - protein, 6 aa, Artificial Sequence
  Description of Artificial Sequence: Synthetic peptide
  AB001718_HV_cdr3
AAGLFI

SEQ ID NO: 155 - protein, 17 aa, Artificial Sequence
  Description of Artificial Sequence: Synthetic peptide
  AB001609_HV_cdr3
ARSLFPTIFGVEVAFDI

SEQ ID NO: 156 - protein, 11 aa, Artificial Sequence
  Description of Artificial Sequence: Synthetic peptide
  AB001843_HV_cdr3
AKEVFSGWYDY

SEQ ID NO: 157 - protein, 11 aa, Artificial Sequence
  Description of Artificial Sequence: Synthetic peptide
  AB001718_LV_cdr1
RASQYISSGLA

SEQ ID NO: 158 - protein, 11 aa, Artificial Sequence
  Description of Artificial Sequence: Synthetic peptide
  AB001744_LV_cdr1
RASQSIGTGLA

SEQ ID NO: 159 - protein, 11 aa, Artificial Sequence
  Description of Artificial Sequence: Synthetic peptide
  AB002022_LV_cdr1
RASQSIGRWLA

SEQ ID NO: 160 - protein, 11 aa, Artificial Sequence
  Description of Artificial Sequence: Synthetic peptide
  AB001609_LV_cdr1
RASQSISNRLA

SEQ ID NO: 161 - protein, 11 aa, Artificial Sequence
  Description of Artificial Sequence: Synthetic peptide
  AB001638_LV_cdr1
QASQSISNYLA

SEQ ID NO: 162 - protein, 11 aa, Artificial Sequence
  Description of Artificial Sequence: Synthetic peptide
  AB001843_LV_cdr1
RASQSISSYLN

SEQ ID NO: 163 - protein, 7 aa, Artificial Sequence
  Description of Artificial Sequence: Synthetic peptide
  AB001718_LV_cdr2
KASSLDN

SEQ ID NO: 164 - protein, 7 aa, Artificial Sequence
  Description of Artificial Sequence: Synthetic peptide
  AB002022_LV_cdr2
SASNLET

SEQ ID NO: 165 - protein, 7 aa, Artificial Sequence
  Description of Artificial Sequence: Synthetic peptide
  AB001609_LV_cdr2
KASSLES

SEQ ID NO: 166 - protein, 7 aa, Artificial Sequence
  Description of Artificial Sequence: Synthetic peptide
  AB001843_LV_cdr2
AASSLQS

SEQ ID NO: 167 - protein, 7 aa, Artificial Sequence
  Description of Artificial Sequence: Synthetic peptide
  AB001909_LV_cdr2
AASSLES

SEQ ID NO: 168 - protein, 8 aa, Artificial Sequence
  Description of Artificial Sequence: Synthetic peptide
  AB001718_LV_cdr3
QQYERLPL

SEQ ID NO: 169 - protein, 8 aa, Artificial Sequence
  Description of Artificial Sequence: Synthetic peptide
  AB001744_LV_cdr3
QQYNRAPL

SEQ ID NO: 170 - protein, 8 aa, Artificial Sequence
  Description of Artificial Sequence: Synthetic peptide
  AB002022_LV_cdr3
QQYESFPV

SEQ ID NO: 171 - protein, 8 aa, Artificial Sequence
  Description of Artificial Sequence: Synthetic peptide
  AB001609_LV_cdr3
QQSNSTPF

SEQ ID NO: 172 - protein, 8 aa, Artificial Sequence
  Description of Artificial Sequence: Synthetic peptide
  AB001638_LV_cdr3
QQTYSTPI

SEQ ID NO: 173 - protein, 8 aa, Artificial Sequence
  Description of Artificial Sequence: Synthetic peptide
  AB001843_LV_cdr3
QQSYSTPY

SEQ ID NO: 174 - protein, 596 aa, Artificial Sequence
  Description of Artificial Sequence: Synthetic polypeptide
  AF4379_pep1
APTSSSTKKTQLQLEHLLLDLQMILNGINNYKNPKLTDMLTFEFYMPKKATELKHLQCLERELKPLEEVLNLAQSKNFHLRPRDLISNINVIVLELKGSETTFMCEYADETATIVEFLNRWITFCQSIISTLTGGGGSGGGGSGGGGSGGGGSQVQLVQSGAEVKKPGASVKVSCKASGDTFTRYYVHWVRQAPGQGLEWMGIINPSGGYASYAQKFQGRVTMTRDTSTSTVYMELSSLRSEDTAVYYCAAGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 175 - protein, 214 aa, Artificial Sequence
  Description of Artificial Sequence: Synthetic polypeptide
  AF4379_pep2
DIQMTQSPSSLSASVGDRVTITCRASQSIGRYLAWYQQKPGKAPKLLIYSASNLETGVPSRFSGSGSGTDFTLTISSLQPEDFATYYCQQYNSFPVTFGPGTKVDIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 176 - protein, 603 aa, Artificial Sequence
  Description of Artificial Sequence: Synthetic polypeptide
  AF4377_pep1
APTSSSTKKTQLQLEHLLLDLQMILNGINNYKNPKLTDMLTFEFYMPKKATELKHLQCLERELKPLEEVLNLAQSKNFHLRPRDLISNINVIVLELKGSETTFMCEYADETATIVEFLNRWITFCQSIISTLTGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 177 - protein, 600 aa, Artificial Sequence
  Description of Artificial Sequence: Synthetic polypeptide
  AF4378_pep1
APTSSSTKKTQLQLEHLLLDLQMILNGINNYKNPKLTDMLTFEFYMPKKATELKHLQCLERELKPLEEVLNLAQSKNFHLRPRDLISNINVIVLELKGSETTFMCEYADETATIVEFLNRWITFCQSIISTLTGGGGSGGGGSGGGGSGGGGSEVQLVESGGGLVKPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 178 - protein, 214 aa, Artificial Sequence
  Description of Artificial Sequence: Synthetic polypeptide
  AF4378_pep2
DIQMTQSPSSLSASVGDRVSITCKASQNVGTNVGWYQQKPGKAPKALIYSASFRYSGVPSRFSGSGSGTDFTLTISSLQPEDFATYFCQQYYTYPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 179 - protein, 596 aa, Artificial Sequence
  Description of Artificial Sequence: Synthetic polypeptide
  AF4376_pep1
APTSSSTKKTQLQLEHLLLDLQMILNGINNYKNPKLTDMLTFEFYMPKKATELKHLQCLERELKPLEEVLNLAQSKNFHLRPRDLISNINVIVLELKGSETTFMCEYADETATIVEFLNRWITFCQSIISTLTGGGGSGGGGSGGGGSGGGGSQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 180 - protein, 214 aa, Artificial Sequence
  Description of Artificial Sequence: Synthetic polypeptide
  AF4376_pep2
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 181 - protein, 596 aa, Artificial Sequence
  Description of Artificial Sequence: Synthetic polypeptide
  AF4386_pep1
APTSSSTKKTQLQLEHLLLDLQMILNGINNYKNPKLTDMLTFEFYMPKKATELKHLQCLERELKPLEEVLNLAQSKNFHLRPRDLISNINVIVLELKGSETTFMCEYADETATIVEFLNRWITFCQSIISTLTGGGGSGGGGSGGGGSGGGGSQVQLVQSGAEVKKPGASVKVSCKASGDTFTRYYVHWVRQAPGQGLEWMGIINPSGGYASYAQKFQGRVTMTRDTSTSTVYMELSSLRSEDTAVYYCAAGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 182 - protein, 456 aa, Artificial Sequence
  Description of Artificial Sequence: Synthetic polypeptide
  AF4386_pep2
QVQLVQSGAEVKKPGASVKVSCKASGDTFTRYYVHWVRQAPGQGLEWMGIINPSGGYASYAQKFQGRVTMTRDTSTSTVYMELSSLRSEDTAVYYCAAGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGSGGGSHHHHHH

SEQ ID NO: 183 - protein, 596 aa, Artificial Sequence
  Description of Artificial Sequence: Synthetic polypeptide
  AF4387_pep1
APTSSSTKKTQLQLEHLLLDLQMILNGINNYKNPKLTDMLTFEFYMPKKATELKHLQCLERELKPLEEVLNLAQSKNFHLRPRDLISNINVIVLELKGSETTFMCEYADETATIVEFLNRWITFCQSIISTLTGGGGSGGGGSGGGGSGGGGSQVQLVQSGAEVKKPGASVKVSCKASGYTFTDYYMHWVRQAPGQGLEWMGIINPRAGYTSYALKFQGRVTMTRDTSTSTVYMELSSLRSEDTAVYYCTSGWDVWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 184 - protein, 456 aa, Artificial Sequence
  Description of Artificial Sequence: Synthetic polypeptide
  AF4387_pep2
QVQLVQSGAEVKKPGASVKVSCKASGYTFTDYYMHWVRQAPGQGLEWMGIINPRAGYTSYALKFQGRVTMTRDTSTSTVYMELSSLRSEDTAVYYCTSGWDVWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGSGGGSHHHHHH

SEQ ID NO: 185 - protein, 214 aa, Artificial Sequence
  Description of Artificial Sequence: Synthetic polypeptide
  AF4387_pep3
DIQMTQSPSSLSASVGDRVTITCRASQSISTWLAWYQQKPGKAPKLLIYAASSLDSGVPSRFSGSGSGTDFTLTISSLQPEDFATYYCQQSYSFPVTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 186 - protein, 596 aa, Artificial Sequence
  Description of Artificial Sequence: Synthetic polypeptide
  AF4389_pep1
APTSSSTKKTQLQLEHLLLDLQMILNGINNYKNPKLTDMLTFEFYMPKKATELKHLQCLERELKPLEEVLNLAQSKNFHLRPRDLISNINVIVLELKGSETTFMCEYADETATIVEFLNRWITFCQSIISTLTGGGGSGGGGSGGGGSGGGGSQVQLVQSGAEVKKPGASVKVSCKASGHTFTRYYMHWVRQAPGQGLEWMGIINPSGGYATYAQKFQGRVTMTRDTSTSTVYMELSSLRSEDTAVYYCASGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 187 - protein, 456 aa, Artificial Sequence
  Description of Artificial Sequence: Synthetic polypeptide
  AF4389_pep2
QVQLVQSGAEVKKPGASVKVSCKASGHTFTRYYMHWVRQAPGQGLEWMGIINPSGGYATYAQKFQGRVTMTRDTSTSTVYMELSSLRSEDTAVYYCASGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGSGGGSHHHHHH

SEQ ID NO: 188 - protein, 214 aa, Artificial Sequence
  Description of Artificial Sequence: Synthetic polypeptide
  AF4389_pep3
DIQMTQSPSSLSASVGDRVTITCRASQSINSWLAWYQQKPGKAPKLLIYATSTLESGVPSRFSGSGSGTDFTLTISSLQPEDFATYYCQQYYRFPVTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 189 - protein, 596 aa, Artificial Sequence
  Description of Artificial Sequence: Synthetic polypeptide
  AF4380_pep1
APTSSSTKKTQLQLEHLLLDLQMILNGINNYKNPKLTDMLTFEFYMPKKATELKHLQCLERELKPLEEVLNLAQSKNFHLRPRDLISNINVIVLELKGSETTFMCEYADETATIVEFLNRWITFCQSIISTLTGGGGSGGGGSGGGGSGGGGSQVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 190 - protein, 456 aa, Artificial Sequence
  Description of Artificial Sequence: Synthetic polypeptide
  AF4380_pep2
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGSGGGSHHHHHH

SEQ ID NO: 191 - protein, 603 aa, Artificial Sequence
  Description of Artificial Sequence: Synthetic polypeptide
  AF4383_pep1
APTSSSTKKTQLQLEHLLLDLQMILNGINNYKNPKLTDMLTFEFYMPKKATELKHLQCLERELKPLEEVLNLAQSKNFHLRPRDLISNINVIVLELKGSETTFMCEYADETATIVEFLNRWITFCQSIISTLTGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 192 - protein, 463 aa, Artificial Sequence
  Description of Artificial Sequence: Synthetic polypeptide
  AF4383_pep2
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGSGGGSHHHHHH

SEQ ID NO: 193 - protein, 600 aa, Artificial Sequence
  Description of Artificial Sequence: Synthetic polypeptide
  AF4384_pep1
APTSSSTKKTQLQLEHLLLDLQMILNGINNYKNPKLTDMLTFEFYMPKKATELKHLQCLERELKPLEEVLNLAQSKNFHLRPRDLISNINVIVLELKGSETTFMCEYADETATIVEFLNRWITFCQSIISTLTGGGGSGGGGSGGGGSGGGGSEVQLVESGGGLVKPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 194 - protein, 460 aa, Artificial Sequence
  Description of Artificial Sequence: Synthetic polypeptide
  AF4384_pep2
EVQLVESGGGLVKPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGSGGGSHHHHHH

SEQ ID NO: 195 - protein, 716 aa, Artificial Sequence
  Description of Artificial Sequence: Synthetic polypeptide
  AF4403_pep1
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGGSGGGGSGGGGSGGGGSQVQLVQSGAEVKKPGASVKVSCKASGDTFTRYYVHWVRQAPGQGLEWMGIINPSGGYASYAQKFQGRVTMTRDTSTSTVYMELSSLRSEDTAVYYCAAGLFIWGQGTLVTVSSASGGGGSGGGGSGGGGSHASDIQMTQSPSSLSASVGDRVTITCRASQSIGRYLAWYQQKPGKAPKLLIYSASNLETGVPSRFSGSGSGTDFTLTISSLQPEDFATYYCQQYNSFPVTFGPGTKVDIKGGGSGGGSHHHHHH

SEQ ID NO: 196 - protein, 716 aa, Artificial Sequence
  Description of Artificial Sequence: Synthetic polypeptide
  AF4404_pep1
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGGSGGGGSGGGGSGGGGSQVQLVQSGAEVKKPGASVKVSCKASGYTFTDYYMHWVRQAPGQGLEWMGIINPRAGYTSYALKFQGRVTMTRDTSTSTVYMELSSLRSEDTAVYYCTSGWDVWGQGTLVTVSSASGGGGSGGGGSGGGGSHASDIQMTQSPSSLSASVGDRVTITCRASQSISTWLAWYQQKPGKAPKLLIYAASSLDSGVPSRFSGSGSGTDFTLTISSLQPEDFATYYCQQSYSFPVTFGQGTKVEIKGGGSGGGSHHHHHH

SEQ ID NO: 197 - protein, 723 aa, Artificial Sequence
  Description of Artificial Sequence: Synthetic polypeptide
  AF4395_pep1
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGGSGGGGSGGGGSGGGGSQVQLVQSGAEVKKPGASVKVSCKASGDTFTRYYVHWVRQAPGQGLEWMGIINPSGGYASYAQKFQGRVTMTRDTSTSTVYMELSSLRSEDTAVYYCAAGLFIWGQGTLVTVSSASGGGGSGGGGSGGGGSHASDIQMTQSPSSLSASVGDRVTITCRASQSIGRYLAWYQQKPGKAPKLLIYSASNLETGVPSRFSGSGSGTDFTLTISSLQPEDFATYYCQQYNSFPVTFGPGTKVDIKGGGSGGGSHHHHHH

SEQ ID NO: 198 - protein, 723 aa, Artificial Sequence
  Description of Artificial Sequence: Synthetic polypeptide
  AF4396_pep1
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGGSGGGGSGGGGSGGGGSQVQLVQSGAEVKKPGASVKVSCKASGYTFTDYYMHWVRQAPGQGLEWMGIINPRAGYTSYALKFQGRVTMTRDTSTSTVYMELSSLRSEDTAVYYCTSGWDVWGQGTLVTVSSASGGGGSGGGGSGGGGSHASDIQMTQSPSSLSASVGDRVTITCRASQSISTWLAWYQQKPGKAPKLLIYAASSLDSGVPSRFSGSGSGTDFTLTISSLQPEDFATYYCQQSYSFPVTFGQGTKVEIKGGGSGGGSHHHHHH

SEQ ID NO: 199 - protein, 590 aa, Artificial Sequence
  Description of Artificial Sequence: Synthetic polypeptide
  AF4400_pep1
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGGGGGSGGGGSGGGGSAPTSSSTKKTQLQLEHLLLDLQMILNGINNYKNPKLTDMLTFEFYMPKKATELKHLQCLERELKPLEEVLNLAQSKNFHLRPRDLISNINVIVLELKGSETTFMCEYADETATIVEFLNRWITFCQSIISTLT

SEQ ID NO: 200 - protein, 723 aa, Artificial Sequence
  Description of Artificial Sequence: Synthetic polypeptide
  AF4400_pep2
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASGGGGSGGGGSGGGGSHASDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGSGGGSHHHHHH

SEQ ID NO: 201 - protein, 720 aa, Artificial Sequence
  Description of Artificial Sequence: Synthetic polypeptide
  AF4401_pep1
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGGSGGGGSGGGGSGGGGSEVQLVESGGGLVKPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTLVTVSSASGGGGSGGGGSGGGGSHASDIQMTQSPSSLSASVGDRVSITCKASQNVGTNVGWYQQKPGKAPKALIYSASFRYSGVPSRFSGSGSGTDFTLTISSLQPEDFATYFCQQYYTYPYTFGGGTKLEIKGGGSGGGSHHHHHH

SEQ ID NO: 202 - protein, 597 aa, Artificial Sequence
  Description of Artificial Sequence: Synthetic polypeptide
  AF4392_pep1
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGGGGGSGGGGSGGGGSAPTSSSTKKTQLQLEHLLLDLQMILNGINNYKNPKLTDMLTFEFYMPKKATELKHLQCLERELKPLEEVLNLAQSKNFHLRPRDLISNINVIVLELKGSETTFMCEYADETATIVEFLNRWITFCQSIISTLT

SEQ ID NO: 203 - protein, 730 aa, Artificial Sequence
  Description of Artificial Sequence: Synthetic polypeptide
  AF4392_pep2
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASGGGGSGGGGSGGGGSHASDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGSGGGSHHHHHH

SEQ ID NO: 204 - protein, 727 aa, Artificial Sequence
  Description of Artificial Sequence: Synthetic polypeptide
  AF4393_pep1
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGGSGGGGSGGGGSGGGGSEVQLVESGGGLVKPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTLVTVSSASGGGGSGGGGSGGGGSHASDIQMTQSPSSLSASVGDRVSITCKASQNVGTNVGWYQQKPGKAPKALIYSASFRYSGVPSRFSGSGSGTDFTLTISSLQPEDFATYFCQQYYTYPYTFGGGTKLEIKGGGSGGGSHHHHHH

SEQ ID NO: 205 - protein, 596 aa, Artificial Sequence
  Description of Artificial Sequence: Synthetic polypeptide
  AF003247_pep1
APASSSTKKTQLQLEHLLLDLQMILNGINNYKNPKLTRMLTAKFAMPKKATELKHLQCLEEELKPLEEVLNGAQSKNFHLRPRDLISNINVIVLELKGSETTFMCEYADETATIVEFLNRWITFAQSIISTLTGGGGSGGGGSGGGGSGGGGSQVQLVQSGAEVKKPGASVKVSCKASGDTFTRHYVHWVRQAPGQGLEWMGIINPSGGYASYAQKFQGRVTMTRDTSTSTVYMELSSLRSEDTAVYYCAAGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 206 - protein, 214 aa, Artificial Sequence; identical to SEQ ID NO: 116
  Description of Artificial Sequence: Synthetic polypeptide
  AF003247_pep2

SEQ ID NO: 207 - protein, 603 aa, Artificial Sequence
  Description of Artificial Sequence: Synthetic polypeptide
  AF003243_pep1
APASSSTKKTQLQLEHLLLDLQMILNGINNYKNPKLTRMLTAKFAMPKKATELKHLQCLEEELKPLEEVLNGAQSKNFHLRPRDLISNINVIVLELKGSETTFMCEYADETATIVEFLNRWITFAQSIISTLTGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 208 - protein, 600 aa, Artificial Sequence
  Description of Artificial Sequence: Synthetic polypeptide
  AF003246_pep1
APASSSTKKTQLQLEHLLLDLQMILNGINNYKNPKLTRMLTAKFAMPKKATELKHLQCLEEELKPLEEVLNGAQSKNFHLRPRDLISNINVIVLELKGSETTFMCEYADETATIVEFLNRWITFAQSIISTLTGGGGSGGGGSGGGGSGGGGSEVQLVESGGGLVKPGGSLRLSCAASGFTFSSYTLAWVRQAPGKGLEWVAAIDSSSYTYSPDTVRGRFTISRDNAKNSLYLQMNSLRAEDTAVYYCARDSNWDALDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 209 - protein, 214 aa, Artificial Sequence; identical to SEQ ID NO: 178
  Description of Artificial Sequence: Synthetic polypeptide
  AF003246_pep2

SEQ ID NO: 210 - protein, 596 aa, Artificial Sequence
  Description of Artificial Sequence: Synthetic polypeptide
  AF003747_pep1
APASSSTKKTQLQLEHLLLDLQMILNGINNYKNPKLTRMLTAKFAMPKKATELKHLQCLEEELKPLEEVLNGAQSKNFHLRPRDLISNINVIVLELKGSETTFMCEYADETATIVEFLNRWITFAQSIISTLTGGGGSGGGGSGGGGSGGGGSQVQLVQSGAEVKKPGASVKVSCKASGDTFTRYYVHWVRQAPGQGLEWMGIINPSGGYASYAQKFQGRVTMTRDTSTSTVYMELSSLRSEDTAVYYCAAGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 211 - protein, 443 aa, Artificial Sequence
  Description of Artificial Sequence: Synthetic polypeptide
  AF003747_pep2
QVQLVQSGAEVKKPGASVKVSCKASGDTFTRYYVHWVRQAPGQGLEWMGIINPSGGYASYAQKFQGRVTMTRDTSTSTVYMELSSLRSEDTAVYYCAAGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGK

SEQ ID NO: 212 - protein, 214 aa, Artificial Sequence; identical to SEQ ID NO: 175
  Description of Artificial Sequence: Synthetic polypeptide
  AF003747_pep3

SEQ ID NO: 213 - protein, 443 aa, Artificial Sequence
  Description of Artificial Sequence: Synthetic polypeptide
  AF004205_pep1
QVQLVQSGAEVKKPGASVKVSCKASGDTFTRYYVHWVRQAPGQGLEWMGIINPSGGYASYAQKFQGRVTMTRDTSTSTVYMELSSLRSEDTAVYYCAAGLFIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 214 - protein, 450 aa, Artificial Sequence; identical to SEQ ID NO: 65
  Description of Artificial Sequence: Synthetic polypeptide
  AF002725_pep1

SEQ ID NO: 215 - protein, 214 aa, Artificial Sequence; identical to SEQ ID NO: 64
  Description of Artificial Sequence: Synthetic polypeptide
  AF002725_pep2

SEQ ID NO: 216 - protein, 280 aa, Artificial Sequence
  Description of Artificial Sequence: Synthetic polypeptide
  AF000635
MSTSTEQKLISEEDLQVQLVQSGAEVKKPGASVKVSCKASGYTFTGYYIHWVRQAPGQGLEWMGIINPSGGSTRYAQKFQGRVTMTRDTSTSTVYMELSSLRSEDTAVYYCARSLFPTIFGVEVAFDIWGQGTLVTVSSASGGGGSGGGGSGGGGSHASDIQMTQSPSSLSASVGDRVTITCRASQSIRTYLNWYQQKPGKAPKLLIYSASNLQSGVPSRFSGSGSGTDFTLTISSLQPEDFATYYCQQANSFPFTFGPGTKVDIKGKPIPNPLLGLDST

SEQ ID NO: 217 - protein, 280 aa, Artificial Sequence
  Description of Artificial Sequence: Synthetic polypeptide
  AF000636
MSTSTEQKLISEEDLQVQLVQSGAEVKKPGASVKVSCKASGYSFTSYYLHWVRQAPGQGLEWMGRISPRSGGTKNAQNFQGRVTMTRDTSTSTVYMELSSLRSEDTAVYYCVRSLFPTIFGVEVAFDIWGQGTLVTVSSASGGGGSGGGGSGGGGSHASDIQMTQSPSSLSASVGDRVTITCRASQSISSWLAWYQQKPGKAPKLLIYYASSLQSGVPSRFSGSGSGTDFTLTISSLQPEDFATYYCQQGYQYPYTFGQGTKLEIKGKPIPNPLLGLDST

SEQ ID NO: 218 - protein, 280 aa, Artificial Sequence
  Description of Artificial Sequence: Synthetic polypeptide
  AF000666
MSTSTEQKLISEEDLQVQLVQSGAEVKKPGASVKVSCKASGYTFSTYYIHWVRQAPGQGLEWMGWMNPNSGNTGYAQTFQGRVTMTRDTSTSTVYMELSSLRSEDTAVYYCARSLFPTIFGVEVAFDIWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQGYSTPRTFGQGTKVEIKGKPIPNPLLGLDST

SEQ ID NO: 219 - protein, 280 aa, Artificial Sequence
  Description of Artificial Sequence: Synthetic polypeptide
  AF000614
MSTSTEQKLISEEDLQVQLVQSGAEVKKPGASVKVSCKASGYTFTNYYMHWVRQAPGQGLEWMGWMNPNSGNTGYAQKFQGRVTMTRDTSTSTVYMELSSLRSEDTAVYYCARSLFPTIFGVEVAFDIWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKLEIKGKPIPNPLLGLDST

SEQ ID NO: 220 - protein, 520 aa, Artificial Sequence
  Description of Artificial Sequence: Synthetic polypeptide
  AF004455
MSTSTITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGSGSGSGGSGGSGSGGSGSQVQLVQSGAEVKKPGASVKVSCKASGYTFTGYYIHWVRQAPGQGLEWMGIINPSGGSTRYAQKFQGRVTMTRDTSTSTVYMELSSLRSEDTAVYYCARSLFPTIFGVEVAFDIWGQGTLVTVSSASGGGGSGGGGSGGGGSHASDIQMTQSPSSLSASVGDRVTITCRASQSIRTYLNWYQQKPGKAPKLLIYSASNLQSGVPSRFSGSGSGTDFTLTISSLQPEDFATYYCQQANSFPFTFGPGTKVDIKAAAGSGSEQKLISEEDLGKPIPNPLLGLDSTNA

SEQ ID NO: 221 - protein, 520 aa, Artificial Sequence
  Description of Artificial Sequence: Synthetic polypeptide
  AF004456
MSTSTITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGSGSGSGGSGGSGSGGSGSQVQLVQSGAEVKKPGASVKVSCKASGYSFTSYYLHWVRQAPGQGLEWMGRISPRSGGTKNAQNFQGRVTMTRDTSTSTVYMELSSLRSEDTAVYYCVRSLFPTIFGVEVAFDIWGQGTLVTVSSASGGGGSGGGGSGGGGSHASDIQMTQSPSSLSASVGDRVTITCRASQSISSWLAWYQQKPGKAPKLLIYYASSLQSGVPSRFSGSGSGTDFTLTISSLQPEDFATYYCQQGYQYPYTFGQGTKLEIKAAAGSGSEQKLISEEDLGKPIPNPLLGLDSTNA

SEQ ID NO: 222 - protein, 520 aa, Artificial Sequence
  Description of Artificial Sequence: Synthetic polypeptide
  AF004457
MSTSTITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGSGSGSGGSGGSGSGGSGSQVQLVQSGAEVKKPGASVKVSCKASGYTFSTYYIHWVRQAPGQGLEWMGWMNPNSGNTGYAQTFQGRVTMTRDTSTSTVYMELSSLRSEDTAVYYCARSLFPTIFGVEVAFDIWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQGYSTPRTFGQGTKVEIKAAAGSGSEQKLISEEDLGKPIPNPLLGLDSTNA

SEQ ID NO: 223 - protein, 520 aa, Artificial Sequence
  Description of Artificial Sequence: Synthetic polypeptide
  AF004440
MSTSTITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGSGSGSGGSGGSGSGGSGSQVQLVQSGAEVKKPGASVKVSCKASGYTFTNYYMHWVRQAPGQGLEWMGWMNPNSGNTGYAQKFQGRVTMTRDTSTSTVYMELSSLRSEDTAVYYCARSLFPTIFGVEVAFDIWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKLEIKAAAGSGSEQKLISEEDLGKPIPNPLLGLDSTNA

SEQ ID NO: 224 - protein, 520 aa, Artificial Sequence
  Description of Artificial Sequence: Synthetic polypeptide
  AF004447
MSTSTITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGSGSGSGGSGGSGSGGSGSQVQLVQSGAEVKKPGASVKVSCKASGYTFTGYYIHWVRQAPGQGLEWMGWMNPNSGNTGYAQKFQGRVTMTRDTSTSTVYMELSSLRSEDTAVYYCARSLFPTIFGVEVAFDIWGQGTLVTVSSASGGGGSGGGGSGGGGSHASDIQMTQSPSSLSASVGDRVTITCRASRSISSYLNWYQQKPGKAPKLLIYAASSLQSGVPSRFSGSGSGTDFTLTISSLQPEDFATYYCQQSYSTPRTFGQGTKVEIKAAAGSGSEQKLISEEDLGKPIPNPLLGLDSTNA

SEQ ID NO: 225 - protein, 519 aa, Artificial Sequence
  Description of Artificial Sequence: Synthetic polypeptide
  AF004479
MSTSTITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGSGSGSGGSGGSGSGGSGSQVQLVQSGAEVKKPGSSVKVSCKASGYSFTDYYVHWVRQAPGQGLEWVGGINPKRGDTVFAQKFQGRVTITADESTSTAYMELSSLRSEDTAVYYCARGGLGVFGVVDVWGQGTTVTVSSASGGGGSGGGGSGGGGSHASDIVMTQSPLSLPVTPGEPASISCRSSQSLLHSNGYNYLDWYLQKPGQSPQLLIYAATTLQSGVPDRFSGSGSGTDFTLKISRVEAEDVGVYYCMQALQTPLTFGGGTKLEIKAAAGSGSEQKLISEEDLGKPIPNPLLGLDST

SEQ ID NO: 226 - protein, 685 aa, Artificial Sequence
  Description of Artificial Sequence: Synthetic polypeptide
  AF004591_Pep1
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSGGGGSQVQLVQSGAEVKKPGASVKVSCKASGYTFTNYYMHWVRQAPGQGLEWMGWMNPNSGNTGYAQKFQGRVTMTRDTSTSTVYMELSSLRSEDTAVYYCARSLFPTIFGVEVAFDIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 227 - protein, 454 aa, Artificial Sequence
  Description of Artificial Sequence: Synthetic polypeptide
  AF004591_Pep2
QVQLVQSGAEVKKPGASVKVSCKASGYTFTNYYMHWVRQAPGQGLEWMGWMNPNSGNTGYAQKFQGRVTMTRDTSTSTVYMELSSLRSEDTAVYYCARSLFPTIFGVEVAFDIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGK

SEQ ID NO: 228 - protein, 214 aa, Artificial Sequence
  Description of Artificial Sequence: Synthetic polypeptide
  AF004591_Pep3
DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 229 - protein, 685 aa, Artificial Sequence
  Description of Artificial Sequence: Synthetic polypeptide
  AF004592_Pep1
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSGGGGSQVQLVQSGAEVKKPGASVKVSCKASGYTFSTYYIHWVRQAPGQGLEWMGWMNPNSGNTGYAQTFQGRVTMTRDTSTSTVYMELSSLRSEDTAVYYCARSLFPTIFGVEVAFDIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 230 - protein, 454 aa, Artificial Sequence
  Description of Artificial Sequence: Synthetic polypeptide
  AF004592_Pep2
QVQLVQSGAEVKKPGASVKVSCKASGYTFSTYYIHWVRQAPGQGLEWMGWMNPNSGNTGYAQTFQGRVTMTRDTSTSTVYMELSSLRSEDTAVYYCARSLFPTIFGVEVAFDIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGK

SEQ ID NO: 231 - protein, 214 aa, Artificial Sequence
  Description of Artificial Sequence: Synthetic polypeptide
  AF004592_Pep3
DIQMTQSPSSLSASVGDRVTITCRASQSISSYLNWYQQKPGKAPKLLIYAASSLQSGVPSRFSGSGSGTDFTLTISSLQPEDFATYYCQQGYSTPRTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 232 - protein, 677 aa, Artificial Sequence
  Description of Artificial Sequence: Synthetic polypeptide
  AF004659_Pep1
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSGGGGSQVQLVQSGAEVKKPGASVKVSCKASGDTFSSYAISWVRQAPGQGLEWMGWMNPNSGNTGYAQKFQGRVTMTRDTSTSTVYMELSSLRSEDTAVYYCATGITMIGYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 233 - protein, 446 aa, Artificial Sequence
  Description of Artificial Sequence: Synthetic polypeptide
  AF004659_Pep2
QVQLVQSGAEVKKPGASVKVSCKASGDTFSSYAISWVRQAPGQGLEWMGWMNPNSGNTGYAQKFQGRVTMTRDTSTSTVYMELSSLRSEDTAVYYCATGITMIGYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGK

SEQ ID NO: 234 - protein, 214 aa, Artificial Sequence
  Description of Artificial Sequence: Synthetic polypeptide
  AF004659_Pep3
DIQMTQSPSSLSASVGDRVTITCQASQDISSYLNWYQQKPGKAPKLLIYAASTLQSGVPSRFSGSGSGTDFTLTISSLQPEDFATYYCQQSYSTPYTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 235 - protein, 685 aa, Artificial Sequence
  Description of Artificial Sequence: Synthetic polypeptide
  AF004660_Pep1
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSGGGGSQVQLVQSGAEVKKPGASVKVSCKASGGTFSSYAISWVRQAPGQGLEWMGIIDPSMTYTRYAQKFQGRVTMTRDTSTSTVYMELSSLRSEDTAVYYCARSLFPTIFGLEVAFDIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 236 - protein, 454 aa, Artificial Sequence
  Description of Artificial Sequence: Synthetic polypeptide
  AF004660_Pep2
QVQLVQSGAEVKKPGASVKVSCKASGGTFSSYAISWVRQAPGQGLEWMGIIDPSMTYTRYAQKFQGRVTMTRDTSTSTVYMELSSLRSEDTAVYYCARSLFPTIFGLEVAFDIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGK

SEQ ID NO: 237 - protein, 214 aa, Artificial Sequence
  Description of Artificial Sequence: Synthetic polypeptide
  AF004660_Pep3
DIQMTQSPSSLSASVGDRVTITCQASQSISNRLAWYQQKPGKAPKLLIYKASSLESGVPSRFSGSGSGTDFTLTISSLQPEDFATYYCQQTYSTPITFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 238 - protein, 15 aa, Artificial Sequence
  Description of Artificial Sequence: Synthetic peptide
  HC-CDR3 of IFNa binder
CASGGSYSPWYFDLW

SEQ ID NO: 239 - protein, 18 aa, Artificial Sequence
  Description of Artificial Sequence: Synthetic peptide
  HC-CDR3 of IFNa binder
CASLAAAGPYYYYGMDVW

SEQ ID NO: 240 - protein, 18 aa, Artificial Sequence
  Description of Artificial Sequence: Synthetic peptide
  HC-CDR3 of IFNa binder
CVSSVGAGAYYYQGLDVW

SEQ ID NO: 241 - protein, 14 aa, Artificial Sequence
  Description of Artificial Sequence: Synthetic peptide
  HC-CDR3 of IFNa binder
CARDHDYLTSFGYW

SEQ ID NO: 242 - protein, 17 aa, Artificial Sequence
  Description of Artificial Sequence: Synthetic peptide
  HC-CDR3 of IFNa binder
CAFSSPTYYYYYGMDVW

SEQ ID NO: 243 - protein, 19 aa, Artificial Sequence
  Description of Artificial Sequence: Synthetic peptide
  HC-CDR3 of IFNa binder
CARVNYDFWSGQSLRFDPW

SEQ ID NO: 244 - protein, 18 aa, Artificial Sequence
  Description of Artificial Sequence: Synthetic peptide
  HC-CDR3 of IFNa binder
CATIKGLGAYYYYGMDVW

SEQ ID NO: 245 - protein, 14 aa, Artificial Sequence
  Description of Artificial Sequence: Synthetic peptide
  HC-CDR3 of IFNa binder
CASDHGWLDAFDIW

SEQ ID NO: 246 - protein, 13 aa, Artificial Sequence
  Description of Artificial Sequence: Synthetic peptide
  HC-CDR3 of IFNa binder
CARDWYGDYFDYW

SEQ ID NO: 247 - protein, 17 aa, Artificial Sequence
  Description of Artificial Sequence: Synthetic peptide
  HC-CDR3 of IFNa binder
CARGILSDYGDHAFDYW

SEQ ID NO: 248 - protein, 15 aa, Artificial Sequence
  Description of Artificial Sequence: Synthetic peptide
  HC-CDR3 of IFNa binder
CARVDSSSSLHFDYW

SEQ ID NO: 249 - protein, 14 aa, Artificial Sequence
  Description of Artificial Sequence: Synthetic peptide
  HC-CDR3 of IFNa binder
CARTSGYDLLFDYW

SEQ ID NO: 250 - protein, 18 aa, Artificial Sequence
  Description of Artificial Sequence: Synthetic peptide
  HC-CDR3 of IFNa binder
CARVGGWGIYYYYGMDVW

SEQ ID NO: 251 - protein, 15 aa, Artificial Sequence
  Description of Artificial Sequence: Synthetic peptide
  HC-CDR3 of IFNa binder
CARDPSYSTGYYDYW

SEQ ID NO: 252 - protein, 10 aa, Artificial Sequence [sequence omitted]

SEQ ID NO: 253 - protein, 286 aa, Artificial Sequence
  Description of Artificial Sequence: Synthetic polypeptide
  8b2_A09
MSTSTEVQLLESGGGLVQPGGSLRLSCAASGFTFSSYAMHWVRQAPGKGLEWVSAIGAGGGTYYADSVKGRFTISRDDSKNTLYLQMNSLKTEDTAVYYCVSSVGAGAYYYQGLDVWGQGTLVTVSSASGGGGSGGGGSGGGGSHASDIQMTQSPSSLSASVGDRVTITCRASQDIFTYLNWYQQRPGKAPKLLIYDASRLQTGVPSRFSGSGSGTDFTLTISSLQPEDFATYYCQQSYSIPYTFGQGTKLEIKRAAAGSGSEQKLISEEDLGKPIPNPLLGLDST

SEQ ID NO: 254 - protein, 287 aa, Artificial Sequence
  Description of Artificial Sequence: Synthetic polypeptide
  8b2_B10
MSTSTEVQLLESGAEVKKPGGSLRLSCAASGFTVSSNYMSWVRQAPGKGLEWVSAISGSGGSTYYADFVKGRFTISRDNSKNTLYLQMNSLRAEDTAVYYCVSSVGAGAYYYQGLDVWGQGTLVTVSSASGGGGSGGGGSGGGGSHASDIQMTQSPSSLSASVGDRVTITCRASQGVGNFLAWYQQKPGKAPKLLIYGASTLQSGVPSRFSGSGSGTDFTLTISSLQPEDFATYYCQQSYSTPFTFGGGTKLEIKRAAAGSGSEQKLISEEDLGKPIPNPLLGLDST

SEQ ID NO: 255 - skipped

SEQ ID NO: 256 - protein, 284 aa, Artificial Sequence
  Description of Artificial Sequence: Synthetic polypeptide
  8b2_C08
MSTSTEVQLLESGAEVKKPGGSLRLSCAASGFTFSSYAMSWVRQAPGKGLEWVSAISGSGGSTYYADSVKGRFTISRDNSKNTLYLQMNSLRAEDTAVYYCARVDSSSSLHFDYWGQGTLVTVSSASGGGGSGGGGSGGGGSHASDIQMTQSPSSLSASVGDRVTITCRASQRIGTYLNWYQQKPGKAPKLLIYAASNLQSGVPSRFSGSGSGTDFTLTISSLQPEDFATYYCLQTFNTPFTFGPGTKVDIKRAAAGSGSEQKLISEEDLGKPIPNPLLGLDST

SEQ ID NO: 257 - protein, 296 aa, Artificial Sequence
  Description of Artificial Sequence: Synthetic polypeptide
  AF000317
MSTSTEQKLISEEDLQVQLVQSGAEVKKPGASVKVSCKASGYSFTSYDINWVRQAPGQGLEWIGMINPSSGFTSAAQTFQGRVTMTRDTSTSTVYMELSSLRSEDTAVYYCATIKGLGAYYYYGMDVWGQGTTVTVSSASGGGGSGGGGSGGGGSHASDIQMTQSPSSLSASVGDRVTITCRASQSIDRYLNWYQQKPGKAPKLLIYAASSLQSGVPSRFSGSGSGTDFTLTISSLQPEDFATYYCQQSYSPPLTFGGGTKVEIKGSGLNDIFEAQKIEWHEGKPIPNPLLGLDST

SEQ ID NO: 258 - protein, 293 aa, Artificial Sequence
  Description of Artificial Sequence: Synthetic polypeptide
  AF000372
MSTSTEQKLISEEDLEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASGGGGSGGGGSGGGGSHASDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGSGLNDIFEAQKIEWHEGKPIPNPLLGLDST

SEQ ID NO: 259 - protein, 471 aa, Artificial Sequence
  Description of Artificial Sequence: Synthetic polypeptide
  IFN-8b2_A09
MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGSGSGSGGSGGSGSGGSGSEVQLLESGGGLVQPGGSLRLSCAASGFTFSSYAMHWVRQAPGKGLEWVSAIGAGGGTYYADSVKGRFTISRDDSKNTLYLQMNSLKTEDTAVYYCVSSVGAGAYYYQGLDVWGQGTLVTVSSASGGGGSGGGGSGGGGSHASDIQMTQSPSSLSASVGDRVTITCRASQDIFTYLNWYQQRPGKAPKLLIYDASRLQTGVPSRFSGSGSGTDFTLTISSLQPEDFATYYCQQSYSIPYTFGQGTKLEIKRAAAGSGSEQKLISEEDLGKPIPNPLLGLDST

SEQ ID NO: 260 - protein, 472 aa, Artificial Sequence
  Description of Artificial Sequence: Synthetic polypeptide
  IFN-8b2_B10
MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGSGSGSGGSGGSGSGGSGSEVQLLESGAEVKKPGGSLRLSCAASGFTVSSNYMSWVRQAPGKGLEWVSAISGSGGSTYYADFVKGRFTISRDNSKNTLYLQMNSLRAEDTAVYYCVSSVGAGAYYYQGLDVWGQGTLVTVSSASGGGGSGGGGSGGGGSHASDIQMTQSPSSLSASVGDRVTITCRASQGVGNFLAWYQQKPGKAPKLLIYGASTLQSGVPSRFSGSGSGTDFTLTISSLQPEDFATYYCQQSYSTPFTFGGGTKLEIKRAAAGSGSEQKLISEEDLGKPIPNPLLGLDST

SEQ ID NO: 261 - protein, 469 aa, Artificial Sequence
  Description of Artificial Sequence: Synthetic polypeptide
  IFN-8b2_C08
MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGSGSGSGGSGGSGSGGSGSEVQLLESGAEVKKPGGSLRLSCAASGFTFSSYAMSWVRQAPGKGLEWVSAISGSGGSTYYADSVKGRFTISRDNSKNTLYLQMNSLRAEDTAVYYCARVDSSSSLHFDYWGQGTLVTVSSASGGGGSGGGGSGGGGSHASDIQMTQSPSSLSASVGDRVTITCRASQRIGTYLNWYQQKPGKAPKLLIYAASNLQSGVPSRFSGSGSGTDFTLTISSLQPEDFATYYCLQTFNTPFTFGPGTKVDIKRAAAGSGSEQKLISEEDLGKPIPNPLLGLDST

SEQ ID NO: 262 - protein, 287 aa, Artificial Sequence
  Description of Artificial Sequence: Synthetic polypeptide
  i47_A03
MSTSTQVQLVQSGAEVKKPGASVKVSCKASGYTFTGYYMHWVRQAPGQGLEWMGWMDPNNDDADYAQRFQGRVTMTRDTSTSTVYMELSSLRSEDTAVYYCASLAAAGPYYYYGMDVWGQGTLVTVSSASGGGGSGGGGSGGGGSHASDIQMTQSPSSLSASVGDRVTITCRASQSINNYLNWYQQKPGKAPKLLIYGASNLETGVPSRFSGSGSGTDFTLTISSLQPEDFATYYCQQSYGTPLTFGGGTKVEIKRAAAGSGSEQKLISEEDLGKPIPNPLLGLDST

SEQ ID NO: 263 - protein, 284 aa, Artificial Sequence
  Description of Artificial Sequence: Synthetic polypeptide
  i47_B03
MSTSTQVQLVQSGAEVKKPGASVEVSCKASGGTFSSYAINWVRQAPGQGLEWMGWIDPKSGDTTYAQKFQGRVTMTRDTSTSTVYMELSSLRSEDTAVYYCASGGSYSPWYFDLWGQGTLVTVSSASGGGGSGGGGSGGGGSHASDIQMTQSPSSLSASVGDRVTITCRASQSISSWLAWYQQKSGKAPKLLIYAASSLQSGVPSRFSGSGSGTDFTLTISSLQPEDFATYYCQQAYSFPFTFGPGTKVDIKRAAAGSGSEQKLISEEDLGKPIPNPLLGLDST

SEQ ID NO: 264 - protein, 287 aa, Artificial Sequence
  Description of Artificial Sequence: Synthetic polypeptide
  i47_B07
MSTSTQVQLVQSGAEVKKPGASVKVSCKASGYTFTGYYMHWVRQAPGQGLEWMGWMDPNNDDADYAQRFQGRVTMTRDTSTSTVYMELSSLRSEDTAVYYCASLAAAGPYYYYGMDVWGQGTLVTVSSASGGGGSGGGGSGGGGSHASDIQMTQSPSSLSASVGDRVTITCQASQDISNYLNWYQQKPGKAPKLLIYGASILEAGVPSRFSGSGSGTDFTLTISSLQPEDFATYYCQQSYSAPITFGQGTRLEIKRAAAGSGSEQKLISEEDLGKPIPNPLLGLDST

SEQ ID NO: 265 - protein, 287 aa, Artificial Sequence
  Description of Artificial Sequence: Synthetic polypeptide
  i47_B11
MSTSTQVQLVQSGAEVKKPGSSVKVSCKASGYTFTSYDINWVRQAPGQGLEWLGGTVPLFGISHYAQKFQGRVTITADESTSTAYMELSSLRSEDTAVYYCVSSVGAGAYYYQGLDVWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLLPEDFATYYCQQSYLPPYSFGQGTKLEIKRAAAGSGSEQKLISEEDLGKPIPNPLLGLDST

SEQ ID NO: 266 - protein, 638 aa, Artificial Sequence
  Description of Artificial Sequence: Synthetic polypeptide
  AF004581_pep1
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGYTFTGYYMHWVRQAPGQGLEWMGWMDPNNDDADYAQRFQGRVTMTRDTSTSTVYMELSSLRSEDTAVYYCASLAAAGPYYYYGMDVWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 267 - protein, 453 aa, Artificial Sequence
  Description of Artificial Sequence: Synthetic polypeptide
  AF004581_pep2
QVQLVQSGAEVKKPGASVKVSCKASGYTFTGYYMHWVRQAPGQGLEWMGWMDPNNDDADYAQRFQGRVTMTRDTSTSTVYMELSSLRSEDTAVYYCASLAAAGPYYYYGMDVWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGK

SEQ ID NO: 268 - protein, 214 aa, Artificial Sequence
  Description of Artificial Sequence: Synthetic polypeptide
  AF004581_pep3
DIQMTQSPSSLSASVGDRVTITCRASQSINNYLNWYQQKPGKAPKLLIYGASNLETGVPSRFSGSGSGTDFTLTISSLQPEDFATYYCQQSYGTPLTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 269 - protein, 635 aa, Artificial Sequence
  Description of Artificial Sequence: Synthetic polypeptide
  AF004586_pep1
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVEVSCKASGGTFSSYAINWVRQAPGQGLEWMGWIDPKSGDTTYAQKFQGRVTMTRDTSTSTVYMELSSLRSEDTAVYYCASGGSYSPWYFDLWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 270 - protein, 450 aa, Artificial Sequence
  Description of Artificial Sequence: Synthetic polypeptide
  AF004586_pep2
QVQLVQSGAEVKKPGASVEVSCKASGGTFSSYAINWVRQAPGQGLEWMGWIDPKSGDTTYAQKFQGRVTMTRDTSTSTVYMELSSLRSEDTAVYYCASGGSYSPWYFDLWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGK

SEQ ID NO: 271 - protein, 214 aa, Artificial Sequence
  Description of Artificial Sequence: Synthetic polypeptide
  AF004586_pep3
DIQMTQSPSSLSASVGDRVTITCRASQSISSWLAWYQQKSGKAPKLLIYAASSLQSGVPSRFSGSGSGTDFTLTISSLQPEDFATYYCQQAYSFPFTFGPGTKVDIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 272 - protein, 214 aa, Artificial Sequence
  Description of Artificial Sequence: Synthetic polypeptide
  AF004587_pep1
DIQMTQSPSSLSASVGDRVTITCQASQDISNYLNWYQQKPGKAPKLLIYGASILEAGVPSRFSGSGSGTDFTLTISSLQPEDFATYYCQQSYSAPITFGQGTRLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 273 - protein, 638 aa, Artificial Sequence
  Description of Artificial Sequence: Synthetic polypeptide
  AF004588_pep1
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGSSVKVSCKASGYTFTSYDINWVRQAPGQGLEWLGGTVPLFGISHYAQKFQGRVTITADESTSTAYMELSSLRSEDTAVYYCVSSVGAGAYYYQGLDVWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 274 - protein, 453 aa, Artificial Sequence
  Description of Artificial Sequence: Synthetic polypeptide
  AF004588_pep2
QVQLVQSGAEVKKPGSSVKVSCKASGYTFTSYDINWVRQAPGQGLEWLGGTVPLFGISHYAQKFQGRVTITADESTSTAYMELSSLRSEDTAVYYCVSSVGAGAYYYQGLDVWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGK

SEQ ID NO: 275 - protein, 214 aa, Artificial Sequence
  Description of Artificial Sequence: Synthetic polypeptide
  AF004588_pep3
DIQMTQSPSSLSASVGDRVTITCRASQSISSYLNWYQQKPGKAPKLLIYAASSLQSGVPSRFSGSGSGTDFTLTISSLLPEDFATYYCQQSYLPPYSFGQGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 276 - protein, 673 aa, Artificial Sequence
  Description of Artificial Sequence: Synthetic polypeptide
  AF002659_Pep1
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEVPGVGVPGAGVPGVGVPGGGVPGVGVPGGGVPGAGVPGGGVPGVGVPGAGVPGVGVPGGGQVQLVQSGAEVKKPGASVKVSCKASGYTFSNYYIHWVRQAPGQGLEWMGWMDSNSGYTGYAQKFQGRVTMTRDTSTSTVYMELSSLRSEDTAVYYCAKEVFSGWYDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 277 - protein, 214 aa, Artificial Sequence; identical to SEQ ID NO: 44
  Description of Artificial Sequence: Synthetic polypeptide
  AF002659_Pep2

SEQ ID NO: 278 - skipped

SEQ ID NO: 279 - protein, 454 aa, Artificial Sequence
  Description of Artificial Sequence: Synthetic polypeptide
  AF002615_pep1
QVQLVQSGAEVKKPGASVKVSCKASGNTFTDYYMHWVRQAPGQGLEWMGWMNPNSGNTGYAQKFQGRVTMTRDTSTSTVYMELSSLRSEDTAVYYCARSLFPTIFGVEVAFDIWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 280 - protein, 399 aa, Artificial Sequence
  Description of Artificial Sequence: Synthetic polypeptide
  AF002615_Pep2
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSDIQMTQSPSSLSASVGDRVTITCQASQDISNYLNWYQQKPGKAPKLLIYAASSLQSGVPSRFSGSGSGTDFTLTISSLQPEDFATYYCQQSYSTPPTFGQGTRLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 281 - protein, 454 aa, Artificial Sequence; identical to SEQ ID NO: 93
  Description of Artificial Sequence: Synthetic polypeptide
  AF002616_Pep1

SEQ ID NO: 282 - protein, 399 aa, Artificial Sequence
  Description of Artificial Sequence: Synthetic polypeptide
  AF002616_Pep2
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSDIQMTQSPSSLSASVGDRVTITCQASQSISNRLAWYQQKPGKAPKLLIYKASSLESGVPSRFSGSGSGTDFTLTISSLQPEDFATYYCQQTYSTPITFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 283 - protein, 448 aa, Artificial Sequence
  Description of Artificial Sequence: Synthetic polypeptide
  AF002696_Pep1
QVQLVQSGAEVKKPGASVKVSCKASGYTFSGYYMHWVRQAPGQGLEWMGWMDPNSGYTGYAHQFQGRVTMTRDTSTSTVYMELSSLRSEDTAVYYCAKEVFSGWYDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 284 - protein, 399 aa, Artificial Sequence
  Description of Artificial Sequence: Synthetic polypeptide
  AF002696_Pep2
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSDIQMTQSPSSLSASVGDRVTITCRASQTISSYLNWYQQKPGKAPKLLIYAASTLESGVPSRFSGSGSGTDFTLTISSLQPEDFATYYCQQGYSTPITFGPGTKVDIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 285 - skipped

SEQ ID NO: 286 - protein, 399 aa, Artificial Sequence
  Description of Artificial Sequence: Synthetic polypeptide
  AF002697_Pep2
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 287 - protein, 447 aa, Artificial Sequence
  Description of Artificial Sequence: Synthetic polypeptide
  AF002698_Pep1
EVQLVESGGGLVQPGGSLRLSCATSGYTFTEYIIHWVRQAPGKGLEWVASINPDYDITNYNQRFKGRFTISLDKSKRTAYLQMNSLRAEDTAVYYCASWISDFFDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 288 - protein, 403 aa, Artificial Sequence
  Description of Artificial Sequence: Synthetic polypeptide
  AF002698_Pep2
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSDIQMTQSPSSLSASVGDRVTITCRASQSVSTSSYSYMHWYQQKPGKAPKVLISYASNLESGVPSRFSGSGSGTDFTLTISSLQPEDFATYYCQHSWGIPRTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 289 - protein, 449 aa, Artificial Sequence
  Description of Artificial Sequence: Synthetic polypeptide
  AF003101
MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGYTFSNYYIHWVRQAPGQGLEWMGWMDGNSGGTGYAQKFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKGKPIPNPLLGLDST

SEQ ID NO: 290 - protein, 449 aa, Artificial Sequence
  Description of Artificial Sequence: Synthetic polypeptide
  AF003093
MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGYTFSNYYIHWVRQAPGQGLEWMGWMDSNSGYTGYAQKFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKGKPIPNPLLGLDST

SEQ ID NO: 291 - protein, 449 aa, Artificial Sequence
  Description of Artificial Sequence: Synthetic polypeptide
  AF003094
MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGYTFSNYYIHWVRQAPGQGLEWMGWMDPNSGYTGYAHQFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKGKPIPNPLLGLDST

SEQ ID NO: 292 - protein, 449 aa, Artificial Sequence
  Description of Artificial Sequence: Synthetic polypeptide
  AF003092
MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGYTFSNYYIHWVRQAPGQGLEWMGWMDPNSGGTGYAQKFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKGKPIPNPLLGLDST

SEQ ID NO: 293 - protein, 449 aa, Artificial Sequence
  Description of Artificial Sequence: Synthetic polypeptide
  AF003099
MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGYTFSGYYIHWVRQAPGQGLEWMGWMDSNSGGTGYAQKFQGRVTMTRDTSTSTVYMELSSLRSEDTAVYYCAKEVFSGWYDYWGQGTLVTVSSASGGGGSGGGGSGGGGSHASDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKGKPIPNPLLGLDST

SEQ ID NO: 294 - protein, 638 aa, Artificial Sequence
  Description of Artificial Sequence: Synthetic polypeptide
  AF004305_pep1
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGSSVKVSCKASGYTFTAYDINWVRQAPGQGLEWVGIINPGSGSPMYAQKFQGRVTITADESTSTAYMELSSLRSEDTAVYYCVSSVGAGAYYYQGLDVWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 295 - protein, 466 aa, Artificial Sequence
  Description of Artificial Sequence: Synthetic polypeptide
  AF004305_pep2
QVQLVQSGAEVKKPGSSVKVSCKASGYTFTAYDINWVRQAPGQGLEWVGIINPGSGSPMYAQKFQGRVTITADESTSTAYMELSSLRSEDTAVYYCVSSVGAGAYYYQGLDVWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGSGGGSHHHHHH

SEQ ID NO: 296 - protein, 214 aa, Artificial Sequence
  Description of Artificial Sequence: Synthetic polypeptide
  AF004305_pep3
DIQMTQSPSSLSASVGDRVTITCQASQDIANYLNWYQQKPGKAPKLLIYSASNLQSGVPSRFSGSGSGTDFTLTISSLQPEDFATYYCQQSYSTQWTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 297 - protein, 635 aa, Artificial Sequence
  Description of Artificial Sequence: Synthetic polypeptide
  AF004306_pep1
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSDLRVEKKNWVERNSYSCSVVHEGLHNHHTTESFSRTPGK

SEQ ID NO: 298 - protein, 464 aa, Artificial Sequence
  Description of Artificial Sequence: Synthetic polypeptide
  AF33_pep1
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGKGGGSGGGSHHHHHH

SEQ ID NO: 299 - protein, 445 aa, Artificial Sequence
  Description of Artificial Sequence: Synthetic polypeptide
  AF33_pep2
ITCPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 300 - protein, 454 aa, Artificial Sequence
  Description of Artificial Sequence: Synthetic polypeptide
  AF002589
MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGYSFTSYDINWVRQAPGQGLEWIGMINPSSGFTSAAQTFQGRVTMTRDTSTSTVYMELSSLRSEDTAVYYCATIKGLGAYYYYGMDVWGQGTTVTVSSASGGGGSGGGGSGGGGSHASDIQMTQSPSSLSASVGDRVTITCRASQSIDRYLNWYQQKPGKAPKLLIYAASSLQSGVPSRFSGSGSGTDFTLTISSLQPEDFATYYCQQSYSPPLTFGGGTKVEIKGKPIPNPLLGLDST

SEQ ID NO: 301 - protein, 455 aa, Artificial Sequence
  Description of Artificial Sequence: Synthetic polypeptide
  AF002592
MSTSTCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKEGGGGSGGGGSGGGGSGGGGSQVQLVQSGAEVKKPGASVKVSCKASGGTFSSYAISWVRQAPGQGLEWMGWINPNSGGTNYAQKFQGRVTMTRDTSTSTVYMELSSLRSEDTAVYYCARSLFPTIFGVEVAFDIWGQGTTVTVSSASGGGGSGGGGSGGGGSHASDIQMTQSPSSLSASVGDRVTITCRASQSIIDRLAWYQQKPGKAPKLLIYKASSLESGVPSRFSGSGSGTDFTLTISSLQPEDFATYYCQQSYSTPFTFGPGTKVDIKGKPIPNPLLGLDST

SEQ ID NO: 302 - protein, 451 aa, Artificial Sequence; identical to SEQ ID NO: 56
  Description of Artificial Sequence: Synthetic polypeptide
  AF002594

SEQ ID NO: 303 - protein, 702 aa, Artificial Sequence
  Description of Artificial Sequence: Synthetic polypeptide
  AF4505_pep2
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGGSGGGGSGGGGSGGGGSQVQLVQSGAEVKKPGASVKVSCKASGDTFTRYYVHWVRQAPGQGLEWMGIINPSGGYASYAQKFQGRVTMTRDTSTSTVYMELSSLRSEDTAVYYCAAGLFIWGQGTLVTVSSASGGGGSGGGGSGGGGSHASDIQMTQSPSSLSASVGDRVTITCRASQSIGRWLAWYQQKPGKAPKLLIYSASNLETGVPSRFSGSGSGTDFTLTISSLQPEDFATYYCQQYNRFPVTFGPGTKVDIK

SEQ ID NO: 304 - protein, 702 aa, Artificial Sequence
  Description of Artificial Sequence: Synthetic polypeptide
  AF4504_pep2
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNAAGGPSVFIFPPKIKDVLMISLSPIVTCVVVDVSEDDPDVQISWFVNNVEVHTAQTQTHREDYNSTLRVVSALPIQHQDWMSGKEFKCKVNNKDLGAPIERTISKPKGSVRAPQVYVLPPPEKEMTKKQVSLTCLVKDFMPEDIYVEWTNNGKTELNYKNTEPVLKSDGSYFMYSKLTVEKKNWVERNSYSCSVVHEGLHNHHTTKSFSRTPGGGGGSGGGGSGGGGSGGGGSQVQLVQSGAEVKKPGASVKVSCKASGYTFTRYYMHWVRQAPGQGLEWMGIINPRAGYTSYALKFQGRVTMTRDTSTSTVYMELSSLRSEDTAVYYCTSGWDVWGQGTLVTVSSASGGGGSGGGGSGGGGSHASDIQMTQSPSSLSASVGDRVTITCRASQSISTWLAWYQQKPGKAPKLLIYAASSLDSGVPSRFSGSGSGTDFTLTISSLQPEDFATYYCQQSYSFPVTFGQGTKVEIK

SEQ ID NO: 305 - protein, 15 aa, Artificial Sequence
  Description of Artificial Sequence: Synthetic peptide
  Parental monospecific antibody PDL1_02_A08
CKASGYTFSGYYMHW

SEQ ID NO: 306 - protein, 15 aa, Artificial Sequence
  Description of Artificial Sequence: Synthetic peptide
  Dual-binding antibody (DBA) PDL1-IFN R01 A05
CKASGYTFSNYYIHW

SEQ ID NO: 307 - protein, 15 aa, Artificial Sequence
  Description of Artificial Sequence: Synthetic peptide
  DBA variant H_N36G
CKASGYTFSGYYIHW

SEQ ID NO: 308 - protein, 15 aa, Artificial Sequence
  Description of Artificial Sequence: Synthetic peptide
  DBA variant H_I39V_S58P_Q69H_K70Q
CKASGYTFSNYYVHW

SEQ ID NO: 309 - protein, 15 aa, Artificial Sequence
  Description of Artificial Sequence: Synthetic peptide
  DBA variant H_G64Y_Q69H
CKASGYTFSNYYIHW

SEQ ID NO: 310 - protein, 14 aa, Artificial Sequence
  Description of Artificial Sequence: Synthetic peptide
  Parental monospecific antibody PDL1 02 A08
CRASQTISSYLNWY

SEQ ID NO: 311 - protein, 14 aa, Artificial Sequence
  Description of Artificial Sequence: Synthetic peptide
  Dual-binding antibody (DBA) PDL1-IFN_R01_A05
CRASQSISSYLNWY

SEQ ID NO: 312 - protein, 14 aa, Artificial Sequence
  Description of Artificial Sequence: Synthetic peptide
  L_Q68E
CRASQSISSYLNWY

SEQ ID NO: 313 - protein, 14 aa, Artificial Sequence
  Description of Artificial Sequence: Synthetic peptide
  L_Q68E_E125D
CRASQSISSYLNWY

SEQ ID NO: 314 - protein, 287 aa, Artificial Sequence
  Description of Artificial Sequence: Synthetic polypeptide
  i47_A11
MSTSTQVQLVQSGAEVKKPGSSVKVSCKASGYTFTSYDINWVRQAPGQGLEWMGTINPSDGDTTYAQKFQGRVTITADESTSTAYMELSSLRSEDTAVYYCARVGGWGIYYYYGMDVWGQGTLVTVSSASGGGGSGGGGSGGGGSHASDIQMTQSPSSLSASVGDRVTITCRASQSINSWLAWYQQKPGKAPKLLIYAASSLQSGVPSRFSGSGSGTDFTLTISSLQPEDFATYYCQQTYTVPFSFGQGTKLEIKRAAAGSGSEQKLISEEDLGKPIPNPLLGLDST

SEQ ID NO: 315 - protein, 287 aa, Artificial Sequence
  Description of Artificial Sequence: Synthetic polypeptide
  i47_A12
MSTSTQVQLVQSGAEVKKPGSSVKVSCKASGYTFINNDINWVRQAPGQGLEWMGGTIPIFGVHIYAQKFQGRVTITADESTSTAYMELSSLRSEDTAVYYCVSSVGAGAYYYYGMDVWGQGTLVTVSSASGGGGSGGGGSGGGGSHASDIQMTQSPSSLSASVGDRVTITCQASQDISNYLNWYQQKPGKAPKLLIYAASSLQSGVPSRFSGSGSGTDFTLTISSLQPEDFATYYCQQSYSLPYTFGQGTRLEIKRAAAGSGSEQKLISEEDLGKPIPNPLLGLDST

SEQ ID NO: 316 - protein, 22 aa, Artificial Sequence
  Description of Artificial Sequence: Synthetic peptide
WMGWMDPNSGYTGYAHQFQGRV

SEQ ID NO: 317 - protein, 22 aa, Artificial Sequence
  Description of Artificial Sequence: Synthetic peptide
WMGWMDSNSGGTGYAQKFQGRV

SEQ ID NO: 318 - protein, 22 aa, Artificial Sequence
  Description of Artificial Sequence: Synthetic peptide
WMGWMDPNSGGTGYAHQFQGRV

SEQ ID NO: 319 - protein, 22 aa, Artificial Sequence
  Description of Artificial Sequence: Synthetic peptide
WMGWMDSNSGYTGYAHKFQGRV

SEQ ID NO: 320 - protein, 14 aa, Artificial Sequence
  Description of Artificial Sequence: Synthetic peptide
IYAASTLESGVPSR

SEQ ID NO: 321 - protein, 14 aa, Artificial Sequence
  Description of Artificial Sequence: Synthetic peptide
IYAASSLQSGVPSR

SEQ ID NO: 322 - protein, 14 aa, Artificial Sequence
  Description of Artificial Sequence: Synthetic peptide
IYAASSLESGVPSR

SEQ ID NO: 323 - protein, 15 aa, Artificial Sequence
  Description of Artificial Sequence: Synthetic peptide
CAKEVFSGWYDYWGQ

SEQ ID NO: 324 - protein, 22 aa, Artificial Sequence
  Description of Artificial Sequence: Synthetic peptide
YYCQQGYSTPITFGPGTKVDIK

SEQ ID NO: 325 - protein, 22 aa, Artificial Sequence
  Description of Artificial Sequence: Synthetic peptide
YYCQQSYSTPYTFGQGTKVEIK

SEQ ID NO: 326 - protein, 22 aa, Artificial Sequence
  Description of Artificial Sequence: Synthetic peptide
YYCQQSYSTPYTFGQGTKVDIK

SEQ ID NO: 327 - protein, 20 aa, Artificial Sequence
  Description of Artificial Sequence: Synthetic peptide
GGGGSGGGGSGGGGSGGGGS

SEQ ID NO: 328 - protein, 280 aa, Artificial Sequence
  Description of Artificial Sequence: Synthetic polypeptide
MSTSTEQKLISEEDLQVQLVQSGAEVKKPGASVKVSCKASGGTFSSYAISWVRQAPGQGLEWMGIIDPSVTYTRYAQKFQGRVTMTRDTSTSTVYMELSSLRSEDTAVYYCARSLFPTIFGVEVAFDIWGQGTLVTVSSASGGGGSGGGGSGGGGSHASDIQMTQSPSSLSASVGDRVTITCQASQDISNYLNWYQQKPGKAPKLLIYGASTLQSGVPSRFSGSGSGTDFTLTISSLQPEDFATYYCQQTYSTPITFGQGTKVEIKGKPIPNPLLGLDST

What is claimed is:

1. A complex comprising:
   a) a therapeutic domain that comprises a cytokine; and
   b) a sensor domain that is a dual-binding antibody or antigen-binding fragment thereof, wherein the sensor domain comprises a heavy chain variable domain and a light chain variable domain, wherein a C-terminus of the therapeutic domain is joined to an N-terminus of the heavy chain variable domain by a linker, or the C-terminus of the therapeutic domain is joined to an N-terminus of the light chain variable domain by the linker, wherein the heavy chain variable domain and the light chain variable domain are present in an IgG isotype antibody or a single chain variable fragment (scFv); wherein the sensor domain binds: (i) the cytokine; and (ii) a marker, but not both simultaneously, wherein:
   (i) when the sensor domain is bound to the cytokine, the cytokine is blocked from binding to its receptor; and
   (ii) when the sensor domain is bound to the marker, the sensor domain is blocked from binding the cytokine and the cytokine is capable of binding to its receptor;
   wherein:
   (I) the cytokine is human IL-2 and the marker is human PD-1;
   (II) the cytokine is human IFNα and the marker is human PD-L1; or
   (III) the cytokine is human IL-15 and the marker is human PD-L1.

2. The complex of claim 1, wherein when the cytokine binds to the sensor domain, activity of the cytokine is reduced.

3. The complex of claim 1, wherein the heavy chain variable domain and the light chain variable domain are present in the scFv.

4. The complex of claim 1, wherein the heavy chain variable domain and the light chain variable domain are present in the IgG isotype antibody.

5. The complex of claim 1, wherein the marker is the human PD-L1.

6. The complex of claim 1, wherein the cytokine is the human IL-15.

7. The complex of claim 1, wherein the cytokine is the human IFNα.

8. The complex of claim 1, wherein the cytokine is the human IL-2.

9. The complex of claim 1, wherein the complex comprises two heavy chains and two light chains.

10. The complex of claim 1, wherein the complex comprises an Fc domain.

11. The complex of claim 1, wherein the complex comprises a serum circulation half-life of at least 12 hours.

12. The complex of claim 1, wherein the complex comprises a serum circulation half-life of at least 48 hours.

13. The complex of claim 1, wherein the human PD-1 or the human PD-L1 is expressed by an immune cell.

14. The complex of claim 1, wherein the human PD-1 or the human PD-L1 is expressed by a T cell.

15. The complex of claim 1, wherein the marker is the human PD-1.

16. The complex of claim 14, wherein when the sensor domain binds to the human PD-1 or PD-L1, the therapeutic domain induces T cell activation.

17. The complex of claim 16, wherein the T cell activation is measured by STAT5 phosphorylation.

18. The complex of claim 2, wherein in an absence of the human PD-1 or PD-L1, the sensor domain binds to the cytokine.

19. The complex of claim 1, wherein the cytokine is the human IL-2 and the marker is the human PD-1.

20. The complex of claim 1, wherein the cytokine is the human IFNα and the marker is the human PD-L1.

21. The complex of claim 1, wherein the cytokine is the human IL-15 and the marker is the human PD-L1.

* * * * *